(12) United States Patent
Hosted et al.

(10) Patent No.: US 6,861,513 B2
(45) Date of Patent: Mar. 1, 2005

(54) EVERNINOMICIN BIOSYNTHETIC GENES

(75) Inventors: Thomas J. Hosted, Summit, NJ (US); Tim X. Wang, Roselle Park, NJ (US); Ann C. Horan, Summit, NJ (US)

(73) Assignee: Schering Corporation, Kenilworth, NJ (US)

( * ) Notice: Subject to any disclaimer, the term of this patent is extended or adjusted under 35 U.S.C. 154(b) by 790 days.

(21) Appl. No.: 09/758,759

(22) Filed: Jan. 11, 2001

(65) Prior Publication Data

US 2004/0101832 A1 May 27, 2004

Related U.S. Application Data

(60) Provisional application No. 60/175,751, filed on Jan. 12, 2000.

(51) Int. Cl.[7] .............................................. C07H 21/04
(52) U.S. Cl. ................ 536/23.1; 435/320.1; 435/252.3; 435/471
(58) Field of Search ...................... 536/23.1; 435/252.3, 435/320.1

(56) References Cited

U.S. PATENT DOCUMENTS

| | | | | |
|---|---|---|---|---|
| 4,735,903 | A | * | 4/1988 | Waitz et al. ............. 435/252.1 |
| 5,190,870 | A | | 3/1993 | Lipscomb et al. |
| 5,190,871 | A | | 3/1993 | Cox et al. |
| 5,741,675 | A | | 4/1998 | Friedmann et al. |
| 2003/0143666 | A1 | * | 7/2003 | Staffa et al. ............. 435/69.1 |

FOREIGN PATENT DOCUMENTS

| | | |
|---|---|---|
| EP | 350341 | 5/1989 |
| JP | 3139284 | 6/1991 |
| WO | WO 93/07904 | 4/1993 |
| WO | WO 93/13663 | 7/1993 |
| WO | WO 95/16046 | 6/1995 |
| WO | WO 97/13777 | 4/1997 |

OTHER PUBLICATIONS

Decker, H., (1996), FEMS Microbiology Letters 141:195–201.
Bechthold, A., (1999), Biorganic Chemistry, Diederichsen U. et al. Wiley–VCH Verlag GMBH, Weinheim, Germany, p. 313–321.
Malpartida, F., (1987), Nature, 325:818–821.
Koch, C., (1996), International Journal of Systematic Bacteriology, 46(2):383–387.
International Search Report for International Patent Application No. PCT/US01/01187; Date of Completion: Aug. 7, 2001.

(List continued on next page.)

*Primary Examiner*—Karen A. Lacourciere
*Assistant Examiner*—Tracy Vivlemore

(57) ABSTRACT

This invention is directed to nucleic acids which encode the proteins that direct the synthesis of the orthosomycin everninomicin and to use of the nucleic acids and proteins to produce compounds exhibiting antibiotic activity based on the everninomycin structure. The DNA sequence for the gene clusters responsible for encoding everninomicin biosynthetic genes, which provide the machinery for producing everninomicin, are provided. Thus, this invention provides the nucleic acid sequences needed to synthesize novel everninomicin-related compounds based on everninomicin, arising from modifications of the DNA sequence designed to change glycosyl and modified orsellinic acid groups contained in everninomicin. A *Micromonospora* site-specific integrase gene is also provided, which can be incorporated in a vector for integration into any actinomycete, and, particularly into *Monospora*. Thus, the invention further provides methods for introducing heterologous genes into an actinomycete chromosome using this particular vector.

12 Claims, 128 Drawing Sheets

OTHER PUBLICATIONS

Adrian PV, et al., 2000, *Antimicrob Agents Chemother.* 44: 732–738.
Altreuter and Clark, 1999, Curr. Op. Biotech. 10:130.
Baltz and Hosted, 1996, TIBTECH 14:245.
Baltz et al., 1998, Trends, Microbiol. 2:76–83.
Baltz, 1990, Curr. Op. Biotech. 1:12–20.
Bao et al., 1999, J. Bacteriol 181:4690–5.
Bao W, et al., 1999, *Biochemistry.* 38: 9752–9757.
Beck et al., 1990, European Journal of Biochemistry 192:487–498.
Becker A, etal., 1993, *Mol Gen Genet.* 241: 367–379.
Brautaset T, et al., 2000, *Chem Biol.* 7: 395–403.
Buttner et al., 1990, J. Bacteriol. 172:3367–78.
Cheng–Cai, 1996, Molecular Microbiology 20:9–15.
Cundliffe, 1989, Annual Review of Microbiology 43:207–33.
Distler J, et al., 1987, *Nucleic Acids Res.* 15: 8041–8056.
Donadio et al., 1993, Proc. Natl. Acad. Sci. U.S.A. 90:7119–23.
Fath et al., 1993, Microbial Reviews 57:995–1017.
Faust B, D Hoffmeister, et al., 2000, *Microbiology*, 146: 147–154.
Fernandez et al., 1996, Molecular and General Genetics 251:692–698.
Fernandez et al., 1998, Journal of Bacteriology 18:4929–4937.
Flett F, et al., *FEMS Microbiol Lett.* 155: 223–229.
Foster DR, 1999, *Pharmacotherapy.* 19: 1111–1117.
Gaisser et al., 1997, Journal of Bacteriology 179:6271–6278.
Ganguly AK, et al., 1975, *J Am Chem Soc.* 97: 1982–1985.
Ganguly AK, et al., 1979, *J Antibiot (Tokyo).* 32: 1213–1216.
Garbe TR, et al., 1994 *Microbiology.* 140: 133–138.
Guilfoile et al., 1991, Proc. Natl. Acad. Sci. USA 88:8553–8557.
Hanlon et al., 1997, Molecular Microbiology 23:459–71.
Hopwood, et al., 1990, Annual Review of Microbiology 24:37–66.
Hosted and Baltz, 1997, J. Bacteirol. 179:180–6.
Hung–wen et al., 1994, Annual Review of Microbiology 48:223–56.
Hutchinson CR, et al., 1993, *Antonie Van Leeuwenhoek.* 64: 165–176.
Hutchinson et al., 1995, Annual Review of Microbiology 49:201–238.
Ikeda H, 1999, et al., Proc Natl Acad Sci U S A. 96: 9509–9514.
Johnson et al., 1998, Current Opinion Chem. Biol. 5:642–9.
Kim et al., 1995, J. Bacteriol. 77:1202.
Lichenstein HS, et al., 1990, *Gene.* 88: 81–86.
Liu and Thorson, 1994, Annu. Rev. Microbiol. 48:223.
Liu W, et al., 2000., *Antimicrob Agents Chemother.* 44: 382–392.
Madduri et al., 1998, Nature Biotechnology, 16:69–74.
McNicholas et al., Abstract C–846, ICAAC, San Francisco, CA, 1999.
McNicholas PM, 2000, *Antimicrob Agents Chemother.* 44: 1121–1126.
Merson–Davies LA, et al., 1994, *Mol Microbiol.* 13 ; 349–355.
Mertz JL, et al., 1986, *J Antibot (Tokyo).* 39: 877–887.
Ninet L, F Benazet, et al., 1974, *Experientia.* 30: 1270–1272.
Oh and Chater, 1997, J. Bacteriol. 179:122–7.
Olano et al., 1998, Molecular Gen. Genetics 3:299–308.
Paget E, et al., 1996, *J Bacteriol.* 178: 6357–6360.
Piepersberg W., et al., 1994, *Crit Rev Biotechnol.* 14: 251–285.
Pissowotzki K, et al., 1991, *Mol Gen Genet.* 231: 113–123.
Puar MS, et al., 1998, *J Antibot (Tokyo).* 51: 221–224.
Rao et al., 1987, Methods in Enzymology 153: 166–198.
Reynolds, Proc. Natl. Acad. Sci. USA, 1998, 95:112744.
Rodriguez E, et al., 1999, *Microbiology*, 145: 3109–3119.
Saitou N, et al., 1987, *Mol Biol Evol.* 4: 406–425.
Smith et al., 1997, FEMS Microbiol. Lett. 155:223–9.
Solenberg et al., Chem Biol, 1997, 4:195–202.
Strohl et al., 1991, J. Industr. Microbiol. 7:163.
Stutzman–Engwall KJ, et al., 1992, *J Bacteriol.* 174: 144–154.
Summers et al., 1997, Microbiology 143:3251–3262.
Tang L, et al., 1994, Ann. N Y Acad. Sci. 721:105–16.
Trefzer A., et al., 1999, *Nat Prod Rep.* 16: 283–299.
Ueda et al., 1996, Gene 169:91–95.
van Wageningen AM, et al., 1998, *Chem Biol.* 5: 155–162.
Weinstein MJ; 1965, *Antimicrob Agents Chemother.* 5: 821–827.
Wilson et al., 1998, Gene 214:95–100.
Wohlleben et al., 1994, Acta Microbiol. Immunol. Hung 41:381–9.
Wolk CP, 1991, *Proc. Natl. Acad. Sci.* 5355–5359.
Wright F, et al., 1992, *Gene.* 113: 55–65.
Ylihonko et al., 1996, Microbiology 142:1965.
Zhang et al., 1998, Molecular and General Genetics 258:26–33.

* cited by examiner

3812 CGAGTCCCTCAGCGGGCAGCTCGGGGACGCGCCCGTCGGCACGGTGCCCCTGCCCACCCGTACTCCTGGCTCAGCCGAGTCTCGCTGGGCAGCAGCCCGCCCGCAGCGTACGTGCCG

3928 TCCTGGATGCGGGGCGCGGAGCAGCGGCGGCAGCTGGAGGGCGGCGGCGCACACCGGAGTGCGGGCTGATCACAGGCCCGGACGGTAGGGACGGTAGGGAAGCCCGGCGCAA

4044 CGTTCGAACGTTCGGTGCGCTCTATGCCTCGGCCACGTATACCCCTGCTCCGGCGGGCTCACGGTAAGCCCGGGTGAGCTCCAGGGCGCGTCGGATGGTCGACACGC

4160 TGACCGAGTACAGATCGGCCAGCTCTCGCAGCGACGGGAGCTTCGACCCGGCGGGTACTCGACCCGGCGGGTCGCTGTGCGGATGCGGGGGGTCAGGTCGTCGGGAGGACATGGGG

4276 ATGGGCATGGGGATCTCCCTGGTTGGCCGCCGATGACATCACGCCCGCCACGCTGCCTCAAGCAGTGATTGACCAGTAGTCACACAGTGACCTAGGTTGGCCGATGGGTAC

FIG. 7B(4)

Analysis of M. Carbonacea and M. Halophytica pSPRH840 insertion site AttB/AttP region Alignment of pMLP1 attP region with religation clone edge sequence

```
M. Halophytica PstI relig-9    TGATCAACTCTAGGGGAGGGGTAGGGGAATCCACTCCGGAGACGCCCGGAGCAATCCGGA 60
M. Carb PstI relig-1           TGATCAACTCTAGGGGAGGGGTAGGGGAAT-CNCTCCGGAGACGCCCGGAGCAATCCGGA 59
M. carb PstI relig-4           TGATCAACTCTAGGGGAGGGGTAGGGGAATCCACTCCGGAGACGCCCGGAGCAATCCGGA 60
pMLP1.intTGA.att region        TGATCAACTCTAGGGGAGGGGTAGGGGAATCCACTCCGGAGACGCCCGGAGCAATCCGGA 60

Consensus                      TGATCAACTCTAGGGGAGGGGTAGGGGAATCCNCTCCGGAGACGCCCGGAGCAATCCGGA 60

M. Halophytica PstI relig-9    GCATGACGGAGCAACCAGCAGGTCAGGTGGCCTGTTGACCCCTGACCAGGGCCCCGGTA  120
M. Carb PstI relig-1           GCATGACGGAGCAACCAGCAGGTCAGGTGGCCTGTTGACCCCTGACCAGGGCCCCGGTA  119
M. carb PstI relig-4           GCATGACGGAGCAACCAGCAGGTCAGGTGGCCTGTTGACCCCTGACCAGGGCCCCGGTA  120
pMLP1.intTGA.att region        GCATGACGGAGCAACCAGCAGGTCAGGTGGCCTGTTGACCCCTGACCAGGGCCCCGGTA  120

Consensus                      GCATGACGGAGCAACCAGCAGGTCAGGTGGCCTGTTGACCCCTGACCAGGGCCCCGGTA  120
```

FIG.9A(1)

```
M. Halophytica PstI relig-9    CGGGTTCAATTCCCATCAGTCACCCAGGTAAGACCCAGGTCAGGGCCGGTTCTCACC-G 179
M. Carb PstI relig-1           CGGGTTCAATTCCCATCAGTCACCC---GT-ACACGAAGGCCCCTCCAC-TCGGAGGGG 174
M. carb PstI relig-4           CGGGTTCAATTCCCATCAGTCACCC---GT-ACACGAAGGCCCCTCCAC-TCGGAGGGG 175
pMLP1.intTGA.att region        CGGGTTCAATTCCCATCAGTCACCC---G--GCAAGTGGATCTACTCCACAGCAGATCAG 175

Consensus                      CGGGTTCAATTCCCATCAGTCACCCAGGTARSAMSHRGRYCHVSKCCRSWKCDSABSRG 180

M. Halophytica PstI relig-9    GCCCT-GACGCATTTTCAGGGG------------ 200
M. Carb PstI relig-1           GCCTTCGGCGT-TCCTGAGGGTTCGCG--      200
M. carb PstI relig-4           GCCTTCGGCGT-TCCTGAGGGTTCGC--       200
pMLP1.intTGA.att region        GCCCCCTCCG----AAGAGGGGCCTGAT       200

Consensus                      GCCYCKVCGYATYHWSAGGGKKCSYGAT       209
```

FIG.9A(2)

Insertion juncture pMLP1 attP region

```
  1 TGATCAACTCTAGGGGAGGGGTAGGGGAATCCACTCCGGAGAGCGCCCGGAGCAATTCGGAGCATGACGGAGCAACCAGCAGGTCAGGTGGCCT

94 GTTGACCCCCTGACCAGGGCCCCGGTACCGGGGTTCAATTCCCATCAGTCACCCGGCAAGTGGATCTACTCCACAGCAGATC

174 AGGCCCCCTCCGAAGAGGGGGCCTGATGCGTCATAGGGACAGGTAGGGGAACTCAA
```

FIG.9B

```
   1 GGTACCCGACCGTGTCCCGGAACAACGAGTCGAGATACGGCGAGAGGAACACCCCCGGTAGTCCGGGTAGACGGTGGGCGCGAAGGCGTAC
  93 GCGCCTTCGACGGTCAGCGGTCGGGCGGACACCGGCGGGTCAGCTCGTCACGCTGTACGCGGGGACGTACAGGATCCACTGTCCGCCAGCC
       <  *   S  T  V  H  V  R  P  V  Y  L   I  W  Q  G  G  A
 184 CGGCGGGAACTCCTGCTCCTTCGCCATGATCTCGTCGGCGTGGTTCCAGGCGGAAGAGCAGCCGGTAGTCCACCGCGTCGGGCGTGAACGCGTC
       <R  R  F  E  Q  E  K  A  M  I  E  D  A  H  N  W  A  F  L  L  A  Y  D  V  A  D  P  T  F  A  D
 276 CGGGGTGCGCACCGGGATGTGCAGCCGGGTGAGCCGGCCCTGCTTGGCCGGCGTCGTGTCGCACACCAGGAGACCAGGTCCGGGCGGACCGA
       <P  T  R  V  P  I  H  T  G  P  T  L  R  G  Q  K  A  P  T  T  D  C  V  W  S  V  L  D  P  G  I
 368 TGCCCGCAGAAGTTCGTCACGGTGCCCTCTTCGACGCTGCGCCGGTGCCGGGAACCTGTCGAGCCGGTCGGCGACCCTCGGCGTCTCCTCGCCGATCAG
       <G  C  F  N  T  V  T  A  S  K  A  T  A  G  Y  A  V  V  R  K  G  E  A  K  L  S  N  L  L  A
 460 AGCAGGTCGGTGCGGATGCCCTCGACGTCGCGCGGCGAACCTGTCGAGCCGGTCGGCGACCCTCGGCGTCTCCTCGCCGATCAG
       <L  D  T  R  I  G  E  V  D  A  A  F  R  D  L  R  S  R  D  A  V  G  R  A  D  E  E  G  I  L
 552 CGCGGCCACCCGCTCGGCCGTCGCCGCGGCGCGCGGCGATGTGTAGCGGACTCCCCACCGTGCACCGGAAGGCGTTCCACGTCGA
       <A  A  V  R  E  A  P  Q  R  A  G  A  R  A  I  T  Y  R  V  E  G  G  H  V  P  L  R  E  V  D  V
 664 CGAGCGCGAAGCCGAAGGGGCCGCCAGCGCGTCCGAAGACGAAGACCCGTCCGGTCAGCGCGTCAACGCCCCGGAGGATGGAGTCGAG
       <L  A  F  G  F  R  A  A  L  A  Q  V  S  R  A  S  F  F  F  H  E  D  Y  I  Q  D  F  S  T
 736 TTGTCCAGGATGTCCCCGAGGTACGGGTCTCCTCGAAGACGAAGACCCGTCCGGTCAGCGCGTCAACGCCCCGGAGGATGGAGTCGAG
       <K  D  L  I  D  G  L  Y  P  D  E  F  V  F  V  G  D  P  A  L  L  A  D  V  G  R  L  I  S  D  L
 828 GTAGGGATGTGCAGATGTGGCCGGTGTTGGCCGCGAAGATCACATCGGCGGCCACCCCGACGCTGAAGCTGCCGACCAGGTGCCACTCCCGCCTCGTGG
       <Y  P  I  H  C  I  T  N  A  A  F  I  V  D  A  P  G  D  T  E  R  V  R  R  A  T  S  E  E  F  F
 920 ACTCGGTGACCAGCCGCACCCGCTCGAAGCCGAAGATCACATCGGCGGCCACCCCGACGCTGAAGCTGCCGACCAGGTGCCACTCCCGCCTCGTGG
       <E  T  V  V  R  V  G  H  G  R  A  V  D  A  V  G  G  S  P  E  F  G  L  H  R  V  G  A  E  H
1012 ACGGTACGACGAGCATCACCCGCGTTGCAGCCGATCTCCACCGAACGGGTCCGGGCCTGGCCTCGTGCTCCAGCAGGTGCCGCCGGT
       <V  T  R  L  M  V  G  D  N  C  G  I  E  V  V  F  P  D  P  G  T  A  E  H  E  L  L  H  R  A  T
```

FIG. 11A(1)

```
1104 GTCGGGGAAGTGCTTCTGCATCACGGAGGAGCCCGACGAGTGGTAGTCCTGGTGGAACATCTCCTCCGGGGCACTCTCCATGA
      < D   A   F   H   K   Q   M   V   S   S   G   S   S   H   Y   P   Y   D   Q   H   F   M   E   E   R   P   V   E   E   M   L
1196 GCTGCACCATCGTGCAGCCCGCGCAGACCCCACCGTCGTCCGGAGCTGGTCCTCGGTGAGGAACCGGTCGGAG
      < Q   V   M   T   C   G   A   C   V   G   V   A   L   H   F   F   E   D   A   L   Q   D   E   T   L   F   R   D   S
1288 AGCGGCTGCCGACCCAGGTCGAGGAACTGGGTCGGTGCCGACCAGGTGCCGCCACACGCCCGGCAGGTGCCGCCGGGGGCGTGCCGTCGGCTGAATCGGT
      < L   P   Q   R   G   L   D   L   F   Q   A   T   T   G   C   A   R   C   T   G   R   R   P   T   G   D   A   S   D   T
1380 CATCGCATTCCTTCCATGGATACCCCTGCCTCAGGCAGGCGGATGTCAACGACGTCCTTGTCGGGATGGGTCGTCCAGCTCTCGGC
      < M
1469 TGCGGGCGTGCCGGCCGGCGACTCAGAGCGCCGGCGAGCACGTCGCCGAGCGTCGCGATCACCCGGTCCTGCGTCTCCGGCAGCGAGGA
      <·  L   A   A   L   V   D   R   L   A   D   I   V   R   D   Q   T   E   P   P   L   S   P
1560 TACATGGGGAGGAGAAGATCTCGGCCAACCGTTCCGTTGGTGGAGGAGCCGGTCTGGTAGCCGAGCTTGGCGAAGCCGGTCATGGT
      <Y   M   P   L   S   F   I   E   G   A   L   R   E   T   T   P   L   S   G   T   Q   Y   G   L   K   A   F   G   T   M   T
1652 GTGCACCGGCCAGGGTAGCTGGGTAGCTGATGTTGAGCGGCGATGTTCCCGCCGCCAACTGTTCGAGGATGCGGCGGTCGCGGGCGGGGTGGGAACCACGT
      < H   V   P   W   P   Y   S   I   N   L   A   I   D   R   A   A   L   Q   E   L   I   R   D   R   A   P   H   R   V   V   Y
1744 AGACGTACCAGAGCGTGTTCGTTGGTGCCGGTCACCGGAGTCAGGCCCGGATGTCGGCCAGGCCCTCCTCGTAGCGC
      < V   V   Y   W   H   E   N   D   T   A   T   V   P   L   T   L   G   V   Q   D   A   I   D   A   L   G   E   E   Y   R
1836 CGGGCCACGCGCGGCGGCCCCGGCGATGTAGTAGCCGGATCGTCGAGCCTGCGCCGGAGACTCCGGCACCTCGTCGAGCGGGCAGTT
      < R   A   V   A   R   R   G   A   I   Y   D   D   L   R   C   L   K   R   R   L   I   E   A   Q   V   E   D   L   R   C   N
1928 GTGCCCCGGCGTCTCGACGACGTAGTAGACCTGTTCCATGCGTAGTAGCGACTGTCGTGATCACGGCGTCCGGGTGA
      < H   G   P   T   E   V   V   Y   V   Q   E   M   G   Y   Y   R   L   R   R   L   R   E   D   I   V   A   D   A   T   V
2020 CCACGCGCCGCCGTCGCCGTACGCGCCCAGCACCTTCGTCGGATAGAACGAGAAGGCAGCGGCGTCGCCATCGTGCCGGCCAGCCGTCCG
      < H   G   P   T   E   V   V   Y   V   Q   E   M   G   Y   A   G   L   V   K   T   P   Y   F   S   F   A   A   A   D   G   M   T   G   A   L   R   G
2112 CCCCGACGCGCCGCCGTGCGCGACTGCGCGCAGTCCTCCAGAGACCTTGAGGCCGTGTTCCCGGGCCAGCACCCGGTCACCCGAGCACCGGGTCCATGTCGACGCA
      < G   R   R   A   G   H   S   Q   A   C   D   E   L   V   K   L   G   H   E   R   A   V   R   L   V   P   D   M   D   V   C
```

FIG.11A(2)

```
2204 CTGGGCCGTAGAGGTGCACCGGGCAGCAGCGCCCTTGTCGTCCGGGGGTGACCGGCCTCGGCGTGTCCATCAGGTAGTCGTCGGCGC
     <Q  G  Y  L  H  V  P  L  L  A  K  T  R  P  T  V  A  E  A  L  L  E  T  D  M  L  Y  D  D  A  R
2296 GGACGTCCACGAAGACCGGCGTCGCGCGACCGCGTCGATGGCGAGCACGTCGGCGCGTGTTGGAGACGGTGATGACCTCGTCGCCC
     <V  D  V  F  V  P  T  A  G  V  A  D  I  A  L  V  T  P  A  A  T  N  S  V  T  I  V  E  D  G
2388 GGCCCGACGTCGAGCGCCTGGAGTGCGAGCTTGATGGCGTTGGTGCCGTGTCCACCGTGACGCAGTGCGGGCATGTCGTGATAGGCGGCGAA
     <P  G  V  D  L  A  Q  L  A  L  K  I  A  N  T  G  N  D  V  T  V  C  H  P  M  D  H  Y  A  A  F
2480 CTCCTGCTCGAAGCCGGCCACGCTCGCGCCGAGGATGAGGTTCCCGGACTCGAAGACCGTCTGCACGGCGTCGAGGAGGTCGTCGTCCGTTCCT
     <E  Q  E  F  G  R  V  S  A  G  L  I  L  N  G  S  E  F  V  T  Q  V  A  D  L  L  D  D  R  E  K
2572 TCTCGTACTCCGGCAGGTAGCCCCACACTCGGATGGTCATCTTCGCCCTTCTACGCCGAGTCCGGAGCGCGAGCCGCGCACGCTCAT
     <E  Y  E  P  L  Y  G  W  V  R  I  T  M  ·  A  S  T  R  S  R  L  A  R  V  S  M
2661 GTAGTCGTTGTCCGGTCGAGTCCAAGTGCCTGCAAGCCGTCCAGGTAGTCGACGGCGTCGACGTAGGGCTGCATGAACCCGGCCC
     <Y  D  N  D  R  D  L  G  L  A  Q  G  S  L  Y  D  V  A  D  V  Y  S  Y  P  Q  M  F  G  G  A  R
2753 GCACGTCGCGATAGAGCCGGGAGAGCTGCCCGGCGTGTGCGAGGCCGACCAGGTCGTGCAGTCGTCCACCACCGCCGGGGCC
     <V  D  R  Y  L  R  S  L  P  H  G  A  T  Y  A  L  G  G  V  L  S  L  C  D  D  V  V  A  P  A
2845 AGCTCGTTGACGGTCATCTTCGGTACTGGAACGGGGTCCTGGTCGCCGAGCGCGTAGAGCCGGGGTGTCCAGCCCGTCAGGTCGAGCAGCAGGTGTTGCTGCGCTGCTTGCCGGACAGGTTGACGACGCCGGCGC
     <L  E  N  V  T  M  K  A  Y  Q  F  P  T  M  M  R  R  G  R  E  D  P  D  G  S  L  D  V  S  A  A
2937 GTCGGGCGTTGGTCAACGCCGCCGCAGAAACCGACCGCGTCCCGGCGATGCCGCTGGGCGTAGATGCCGAGCTCGTGCCGGCACATGGTCATGATGAGCTG
     <D  A  N  T  L  A  A  G  V  T  T  R  L  A  Y  L  R  T  D  L  G  A  V  L  A  R  A  G  A  R  P
3029 GCTCGCCCGCGGCCAGCCGCGTCCCGCGCGTCGCCGACCGGGTCTAGATCGCCCGCCGGGACGCTCGTCGGCCGGGACCGGTCGAAGAC
     <E  G  G  R  G  A  C  F  G  V  A  I  D  R  A  A  Q  A  I  G  A  Y  I  G  L  M  T  I  S  S
3121 ACCGTCTGCCCGGCCAGCGACCGCCGGGCCGGGGCGCTCCCAGCAGCGGCGTCCGACGTCGGCGGACGAGCTCGTCGAAGAC
     <V  T  Q  G  A  L  V  A  D  R  R  A  G  V  P  G  R  E  L  L  E  D  A  R  V  P  C  R  D  F  V
```

FIG. 11A(3)

```
3213 CACCTCCAGGTCCCCGAGGCACGCATTCCCAGGCCGTCGTCCCAGTTGTCCAGCACCGTGAGCCGTGAGCCCGGGGGCGTCGCGGTGCAGACGCGGCACGG
      < V E L T G S  A R M G L G D W N D L V T L G P A D R H V V P V A
3305 CGAGGAACACCGAGCCGTCGTCGCGCCGCTGGGCGTGCACGAAGAAGTGGGTCGCGATGGGCGCCATGTGTGACCAGCACCTTGCGGCCC
      < L F V S G D D D R R Q A H V F F H T A I P A M S V L V K R G
3397 GACAGCAGCCAGCCGCCCGGCGTGGAATGCAGCTCGGTGACCAGCTCGTCCTTGAGCGCCGCAGACGGCGGCCTCGCCCTC
      < S L L W G G A G D S H L E T V V G P A D K L A G C V A A E G E
3489 CGCCATCGCCCGCAGCAGCCGTCCGCCATCGCGCCGTCGCGTTGCCGTGCCACTCGTAGGTGAGGGTGAGGCCCCGGCTGAGCT
      < A M A R L L R E A M A R V P P T G H Q W E Y T L T L G R S L Q
3581 GCACGTGCCAGGCCAGCGCCGGTGACGCCGTCGGCCTCGACGTCGTTCAGCGCCTCAGCCGCTCGTACAGCGGGTCAACCCAGGCCG
      < V H W A L A T S A D A E A L R M L A T A V D Y L R T L G L G
3673 CCCAGCTCGGCGGGAACGGTGGCGCCATCAACCCGAGCTTCGGCAACGCCTCGACAGTGCCGGTGCCGGTCCGGTG
      < G L E A P V T A G M L G L K A F Q E F A E V P F T G T R D R D
3765 GGCGGGCCTCCGGCACTGATTCTCGGGATCACGCCGGCAAGCAGGTCGACGTCGTGAGCGCGGCGTGAGCGCGGAGATCCGCCG
      < A A E A S I R P I V G A L L D V V T R G A P T L P A R L D A A
3857 CCACCCATCTCCTCGGTCAGATTAGACATCGTTCCGTTCGCGCTGTGCCGAACCTGTCGCTATCAGGGTGCGCGGATCACC
      < V
3947 AATTGCTGCTGATTGTCCACCGACGATGCTCGACAGAGTGCTTGGCGCAACGGCTTGGCGAAACCCTGTCGTGCCGGAGT
      > V K I L F I A G P T K S S L F G L A P L A I A A R M
4039 TCGCCAAGTCTAGTTGGATCACTCGAGCTTCCCCGAGGAAGCCGTGAACCATGGGCGCAGCGGTTGACGTTGCTATATTCGGCCGACACG
      > S G H E V V M A S T Q E V V P A T M S V G L P A F P L A A L T
4131 TGCGGAGGACTCGTGAAGATACTGTTCATCGCAGGAGACCGACGAAGTCCAGTCCACTGGCCTGCAATCGCGCCGGATG
4221 AGCGGGCACGAGGTCGTGATGGCTTCCACGCAGGAGGTCGTCCGGCGACGATGTCCGTCGGGCCTTGCCGGCTGCCGGGGCGCTGAC
      > L A E L M T T D R A G D P L R I P A E D A A F V P F F V G R M
4313 CCTCGCCCGAGCTCATGACCACCGACCGGGCCGGCGATCCGCTGCGCATCCCGGCCGAGGACGCCGCCTTCGTCCCCTTCGTCGGCCGGATGT
```

FIG. 11A(4)

```
4405 TCGGCCGGCTGGCGGCGGATCAGCTGGCTGGATCCGCTGCGCGACCTGGTCGGCGGGTGGCGGCCCGACCTGATCGTCGGCGGCCTAC
     >F  G  R  L  A  A  I  S  L  D  P  L  R  D  L  V  G  G  W  R  P  D  L  I  V  G  G  P  H  A  Y
4497 GCCGCGCCGATCCTGGCCACCGAACTTGGGGTGCCCTGCGTCCGGCACTTGCTCACCGGTGGACCCGGTTCCACTGGAGGGCACCCATCCCGGG
     >A  A  P  I  L  A  T  E  L  G  V  P  C  V  R  H  L  L  T  G  N  P  V  D  R  E  G  T  H  P  G
4589 GGTCGACGAGGAGCTGCGGCCCGAGCTGGCCGCTGGCCTGGCCCAGGTGCCGCCGTTCCACCTGGCCCTGGACATCTTCCCGGCCAGCA
     >V  D  E  E  L  R  P  E  L  A  A  L  G  L  A  Q  V  P  P  F  H  L  A  L  D  I  F  P  A  S
4681 CCCGGATCGACGACGTCCCCGCCGCCCAGCCGGTGCGACCGCCGCTGCGCTGGATCCCGACCAACCAGCAGCAGCCGGTGGCGCCGTGGATGCTC
     >T  R  I  D  D  V  P  P  A  Q  P  V  R  P  L  R  W  I  P  T  N  Q  Q  Q  P  V  A  P  W  M  L
4773 TCGCGCGGGCCGCGTCGAGGTCCTGGTCACCGCCGGCAGTCTGGTCACCACCACCCACAACTTCGACTTCCTCCACGGACTGGCCGGCAC
     >S  R  G  P  R  R  R  V  L  V  T  A  G  S  L  V  T  T  T  H  N  F  D  F  L  H  G  L  A  G  T
4865 CCTGGCCGAGCAGGACGTCGAGGTCGTGGTGCTGCCCCACTGTGACCTGATCGTGCACCACTCCGGCACGATGACCGCGCTGACCGCCCTTGAACGCGGGGGTG
     >L  A  E  Q  D  V  E  V  V  V  A  A  P  P  E  V  G  R  A  L  H  D  V  P  G  V  R  H  A  G
4957 GGCTCCCCGCTGGACGTGGTGCTGCCCCACTGTGACCTGATCGTGCACCACTCCGGCACGATGACCGCGCTGACCGCCCTTGAACGCGGGGGTG
     >W  L  P  L  D  V  V  L  P  H  C  D  L  I  V  H  H  S  G  T  M  T  A  L  T  A  L  N  A  G  V
5049 CCCCAGCTGATCGTGCCGCAGGAGAGCCGGTTCATCGAGTGGGCGCGCAACCTGTCACCCTGGGCGTGGCACAGACCCTCGGCGTGGCCCAGACCCTGGCTCCCGGATCGCCCGGGGAGATCG
     >P  Q  L  I  V  P  Q  E  S  R  F  I  E  W  A  R  N  L  S  T  L  G  V  A  Q  T  L  A  P  G  E
5141 GGACACGCCGGAGGCCGTGGGCAAGGTCGTGGCCGGCAGCAGCTGCTGGAGGATCCGGTTCACCGAGTTCGCCACCCGGGGCCTCTGTGCCAGCAGTGACATGGCGCGTCTGTGACGGCGAGCC
     >D  T  P  E  A  V  G  K  V  A  R  L  L  E  D  P  V  H  A  T  S  A  A  A  I  A  R  E  I
5233 CCGAGAGATGCCCGGACCCGAGAGGTCGTGGGCCAGCTGACCGAGTTCGCCACCCGGGGCCTCACGTGCGCGTCTGTGACGGCGAGCC
     >A  E  M  P  G  P  T  E  V  V  G  Q  L  T  E  F  A  T  R  G  L  T  C  A  S  S  .
                                                                                >V  T  G  G  A
5324 GGGTTCATCGGCTCCCACCTCACGGACGCGCTGCTGCAACGCGGCGACTGTCCACGGGCGGCCCGAGCC
     >G  F  I  G  S  H  L  T  D  A  L  L  E  R  G  D  S  V  T  V  L  D  D  L  S  T  G  R  P  E  R
5416 GCTGCCCGCCGGCGTGCCGCTGCACCACGGGTCGATCACCGACCGGGCGGGTTGACCGGCTGGCCGAGCAGTGTCGCCCGGAGGTCATCT
     >L  P  A  G  V  P  L  H  H  G  S  I  T  D  R  A  G  L  T  R  L  A  E  Q  C  R  P  E  V  I
```

FIG.11A(5)

```
5508 GCCACCTGGCCGCCAGGCGGACGTGCGCAACTCGGTGGCCGACGCCACCTCGGACACCGGGGTCAACGTGGTGGCACGTCCTG
     >C  H  L  A  A  Q  A  D  V  R  N  S  V  A  D  A  T  S  D  T  G  V  N  V  V  G  T  V  N  V  L
5600 GAGGCCGCCCGGGCCATCGACGCCCGGGTGGTCTTCGCCTCCAGCGGCGGCGCCCTCTACGGGGAGGTCGACGAGCTGCCCTCCCCCGAGGA
     >E  E  A  A  R  A  I  D  A  R  V  V  F  A  S  S  G  G  A  L  Y  G  E  V  D  E  L  P  S  P  E  D
5692 CGTCCGGCCGGCCCCGTGGGCGCGTACGGGGCGCCAAGTACTGCGCGGAGCAGTACCTGGCGCTCTACAACCGGCTCTACGGCTCGACCC
     >V  R  P  A  P  W  A  P  Y  G  A  A  K  Y  C  A  E  Q  Y  L  A  L  Y  N  R  L  Y  G  S  T
5784 ACGGGGCGCTGCGGCTCGGCAACGTGTACGGGCCGCGGCAAGACCCAGGACCCGACCGGCGAGGCCGGGGTCGTCTCGATCTTCTGCGGCTGCCTGGTG
     >H  A  A  L  R  L  G  N  V  Y  G  P  R  Q  D  P  T  G  E  A  G  V  V  S  I  F  C  G  C  L  V
5876 GCCGGGCGCCGGCCGACGGTGTTCGGCGACGGCGAGCAGACCCGGGACTACATCTACGTGGCCGACGTTGAGGCGTTCCTGCTCGCGGT
     >A  G  R  R  P  T  V  F  G  D  G  E  Q  T  R  D  Y  I  Y  V  A  D  V  V  E  A  F  L  L  A  V
5968 CGGGGCACGGTGGCCCCGCTTCGAGCACCCGCTGTGGAACATCGGGACCTCCACCAGCATCCGCAAACTGCTGGACCTGGTCGGCCGCACCGCCGGC
     >G  H  G  G  P  G  L  W  N  I  G  T  S  T  S  I  R  K  L  L  D  L  V  G  R  T  A  G
6060 GCGTCCCGGACCCGCTTCGAGGCGCTTGGGGAGCTGAAGCACTCGCGCGCTGGAGGTGACCGGCGAACCGGTCCGGGGGGAGCTGCGCTGG
     >R  V  P  D  P  R  F  E  P  P  R  L  G  E  L  K  H  S  A  L  E  V  T  R  A  A  R  E  L  R  W
6152 GCGGGCCGAAACGAGGCTCGCCGACGGCATCGCGAAGGTCTACAAGTGGGTCGAGGCGGACGAACCGGTCCGGGGGGAGCGATGACCCGCG
                                                                                >M  T  R  .
6242 AGGGGTCAACGCGCGGTTAGGGTCGGCCACCATCGCCGTTAGGGTCACCAGAGATCCGTTGGCTCGGACCGCCGCTCGGCTCGCTGCTCGCC
     >A  A  R  T  R  L  A  D  G  I  A  K  V  Y  K  W  V  E  A  D  E  P  V  R  G  E  R  .
6334 AGCGACAGCGGCTTCGAGCTTGAGCTCTTCTACGTGGACAACGCCTCGGCCGACGGCAGCGTTGGCGCACGTCATGTCCCGGTTCCCGG
     >E  G  S  T  P  P  V  R  V  A  T  I  T  V  G  T  N  E  I  R  W  L  D  R  A  L  G  S  L  L  A
6426 CGTCCGGGTCATCCGAAACCCGAATCCGCCGCAATCTCGGCTTCACCGGCGAAACAACGTCGGCATGCGCGCGGCCCTGGCGGAGGGCTTCGACCACA
     >S  D  T  T  G  F  E  L  T  V  F  Y  V  D  N  A  S  A  D  G  S  V  A  H  V  M  S  A  F  P  G
6518 TCTTCCTGGTCAACCCGGACACCTGGACACCGGGACCTGTCCGCGGGCTGGTCCGCGTGGAGTTCGCGCAGCGGTGGCCGCAGTACGGCGTCATC
     >V  R  V  I  R  N  P  R  N  L  G  F  T  G  A  N  N  V  G  M  R  A  A  L  A  R  G  F  D  H
     >I  F  L  V  N  P  D  T  W  T  P  P  G  L  V  R  G  L  V  E  F  A  Q  R  W  P  Q  Y  G  V  I
```

FIG.11A(6)

```
6610 GGCCCGTTGCAGTACGCTACGACCGGGTCGACCGAGTTGACCGACTTCAACGACTGGACGCAGGTCGCCCTCTACCTGGGCGAGCAGCA
    >G P L Q Y R Y D P A S T E L T D F N D W T Q V A L Y L G E Q H
6702 CACCTTCGCCGGCGACCTGCTGGATCATCCCTCGCACGTCACCGTCCGCGACGTCCGCGACCGCGCGCCCGCGCACCGCGTACGTGC
    >T F A G D L D H P S H V T A T V R D R A P R T L E H A Y V
6794 AGGGCTCGGCGCTGTTCGTCCGGGCCGCCGTGCTGCGTGCTACGCGAGGTCGGCGTGCTGCTGGACCTGGACGAGGTCGACCTG
    >Q G S A L F V R A A V L R E V G L L D E V F H T Y Y E E V D L
6886 TGCCGGCGGGCCCGGTGGGCGGGCTGGCGGTCTCGACCTCGACCATCGGCATCCAGCACAAAGGGCGGTGGCCACGGCGGCGAGCGC
    >C R R A R W A G W R V A L L D L G I Q H K G G G T A A S A
6978 GTACAGCCGGATACACACGCGCCAACCGCTACTACTATCTGCTGACTGTGGACTGGCCCCCGGCCAAGGCGCCCGGCTCCGCCCC
    >Y S R I H M R R N R Y Y Y L L T D V D W P P A K A A R L A A
7070 GCTGGCTGTTCTCCGACGTCCGTGGGCGGGCGTGACGGGCGTGACGCACCGGCTGCTGCGGGCCAGGAGGACGGGCGTCGTGGCCTCGGGTGG
    >R W L F S D V R G R G V T G R T S A G V G A R E T F V A L G W
7162 CTGGCCCGCCAGGCCCCGGTGATCGGGAACGTCGGCGCGCACCGGCACTTCCACTGGCAGGCGGGTTCAGCCAGACCGTCGCCGCGT
    >L A R Q A P V I R E R R R H R L L R A R G T G V D R A R E R
7254 GAAGGAAACCGTGCGGGATGAGCAGGCCACGGATTCTCGTCGCGGGCAACTTCCACTGGCAGGCCGGTTCAGCCAGACCGTCGCCGCGT
    >K E T V R G .
    >M S R P R I L V A G N F H W Q A G F S Q T V A A
7345 ACGTGCGGGGCGGCCGGGAGGCCGACTGCGAGGTGCGCCTCTGCGGGCCTCTGTCCCGGGTCGACGCCGAGACGGCCCACCTGCCGGTC
    >Y V R A A R E A D C E V R L C G P L S R V D A E T A R H L P V
7437 GAGCCGGACCTCCGCTGGGGCACCCACCTGGTGATCATGTTCGAGGCCAAGCAGTTCCTCACCGAGGCGCAACTGGACCTCGTCGAGGCGTT
    >E P D L R W G T H L V I M F E A K Q F L T E A Q L D L V E A F
7529 CCCCCGACAGCGCCGGGCCATCGTCGACTTCGACGGGCACTGGGGTGCCGAGGAGGGCGGGACAGCGGTCGGGCGGTCGGGCGGTCCG
    >P R Q R R A I V D F D G H W G A E E G G D G D S A S G R Y S
7621 CGGAGAGTTGGCGGCGGTTGTACTGAGCCTGGACCTGATCCTGCAACCTGGCGCCGGGCTCCCGGCCGGCCGGTTCTTCAAG
    >A E S W R R L Y S T L S D L I L Q P R L G P L P A G A R F F K
```

FIG. 11A(7)

```
7713 TGCTTCGGCCTGGCAGCGCCGGTGCGCGGCACCCGCTGGAACTGGGCACCGGCGCGGGCCAGTCGCGGCCCGTACGACCTCCAGTACATCGGCAGCAA
      > C F G L A A P V R H P L E L G T G A Q S R P Y D L Q Y I G S N
7805 CTGGTGGCGGTGGGAGCCGATGACCGAGATGGTCGAGGAGCCGGCGGCCGGCCCGGCCGCCGCTGCGCCGCTGCGGGTGTGCGGACGCTGGT
      > W W R W E P M T E M V E A A A A R P P L R R L R V C G R W
7897 GGGACGCGGCGGCAGTTGCGCGGGCTTCGAGGAGGCGACGCTCAGCGAGCCGGGCTGGCTGCGGGCGGTGCGAGGTGCATCCGCCCGTG
      > W D G G S C A G F E E A T L S E P G W L R A R G V E V H P P V
7989 CCGTTCGGCCACGTGGTCGAGCAGATGGGCCGGTCGCTGATCTCACCGGTCCTGGTGCGCCCGCTGGTCACCAGCACGGCCTGTGACCCC
      > P F G H V V E Q M G R S L I S P V L V R P L V T S T G L L T P
8081 CCGGATGATGTTCGAGACGCTGGCCTCGGGCAGCCTGCCCGTGCTGCCCGTCGCCGAAGTTCCTCGCCGGTCTACGCGACGAGGCGGAAC
      > R M F E T L A S G S L P V L P V A A K F L A P V Y G D E A E
8173 ACCTGATGCTCGGCGACGACCCGGCCGGCACGCTGAGCCGGCTCTCGAGGCGTACGACGAGACGGTACGGTGCGGTGAGATTCAGGAC
      > H L M L G D D P A G T L S R L S R L S A E H E R Y G R L V G E I Q D
8265 CGGCTCCGCGTCGAGTACGGTCCCCGCGTCCTCCGGGACCTGCTCGATCTGCTGGCCTGAGGAATGAGGAGCAGATGACCCCCTG
      > R L R V E Y G Y P R V L R D L L D L L A .        > M T P L
8354 CGGATCGCGATGGTCAACATACCGTTCCGGTTGCCGAGCGACGAGCGGATCGGTCCCGCCAGGGGTACGCGGGATCCAGTG
      > R I A M V N I P F R L P S D E R Q W I T V P P Q G Y G G I Q W
8446 GATCGTGGCCAACAAGATCAAGGGCCTGCTCGAACTCGGCACGAGGTGTTCCTGCTCGGTGCCCGGGCAGTCCGCTACGCATCCACGCC
      > I V A N K I K G L L E L G H E V F L L G A P G S P R T H P R
8538 TGACCGTGGTGCCGGGCGAGCCCGAGGACATCCGGGCATGGTTGAAGTCCGGTGAAGTCGTCAAGACTACAGCTGCGCAAG
      > L T V V P A G E P E D I R A W L K S A P V D V V N D Y S C G K
8630 GTGGATCGAGATCGAGCTGCCCCCGGGGGTCGGCCTGGCCTGGCGTGGCGTGCGCCACCACGACCCGGTCCTATCCGGCTGCTGGTACGC
      > V D P I E L P P G V G L V A S H H M T T R P S Y P A G C V Y A
8722 CTCGAAGGCGCAGCGGGAGCAGTGCGGCGGCGCGGACGCCCCGGTCATCCCGATCGGGGTGGATCCGTCGCTCTACCGCCCCGGCGACC
      > S K A Q R E Q C G G G A D A P V I P I G V D P S L Y R P G D
```

FIG.11A(8)

```
8814 GCAAGGAGACGACTTCCTGCTCTTCATGGGCCGGATCTCCCCGTTCAAGGGGCGCTGAGGCGGCGGCCGCGTTCGCCCGGGGCCGGGGCCGCGG
      >R  K  D  D  F  L  L  F  M  G  R  I  S  P  F  K  G  A  L  E  A  A  F  A  R  A  A  G  R  R
8906 CTACTGATGGCCGGTCCGGCTGGGAGCCGGAGTACCTCGACCGGATCATGGGCGAGTACGGCGACCAGGTCACCCTCGTCGGCGAGGTGGGG
      >L  L  M  A  G  P  A  W  E  P  E  Y  L  D  R  I  M  G  E  Y  G  D  H  V  T  L  V  G  E  V  G
8998 GGGGTCAGGAACGTATGGACCTGCTCGCCACGGCTGCCATCCTGGTGCTCTCCCAGCCGGTCCCGGCCCCGTGGGGCGGCACGTGGTGCG
      >G  Q  E  R  M  D  L  L  A  T  A  A  A  I  L  V  L  S  Q  P  V  P  G  P  W  G  G  T  W  C
9090 AGCCGGGTGCGACCGTGGTGTCCGAGGCGGCGGCCAGCGGCACCCCGGTCGGCACGAGCAACGGCTGCCTGGCGGAGATCGTGCCGGCC
      >E  P  G  A  T  V  V  S  E  A  A  A  S  G  T  P  V  V  G  T  S  N  G  C  L  A  E  I  V  P  A
9182 GTCGGCGAGGTGGTGGGCTTCGGCACGGGCTTCGACGAGCGGGAGGCCCGAGCGCTGCTGTCCCGCCTGCCGTCGCCCGCTCAGGCGGGAA
      >V  G  E  V  V  G  F  G  T  G  F  D  E  R  E  A  R  A  V  L  S  R  L  P  S  P  A  Q  A  R  K
9274 GGCCGCGATCCGGTGCTGGGGCACGTGGAGATCGCCCGGCGCTACGAGGCGGTGTACCGCGACGTGCTGGCCGGCGCGCGGTGGTCCTGA
      >A  A  I  R  C  W  G  H  V  E  I  A  R  R  Y  E  A  V  Y  R  D  V  L  A  G  A  R  W  S  .
9365 GCCGGCCCGGGCGGGCTACGGTCGGCAGCCGGATCGGTGTGCCGGTGTCCGGCGGTCCGACACCGGACGCGCGCCCG
      <.  S  R  D  H  L  W  P  R  P  E  P  D  T  V  E  V  P  Q  S  M  F  V  L  V  Y  A  R
9457 GCCAGGTCAGCTCCGGTCGTGCAGCCAGGGTCGCGGTAGTGCGGTAGTGCCCGGCGCTCGCCCGGCCGCTCGCCCGCAGGCGACGCT
      <R  P  Q  D  T  E  N  P  G  A  Y  H  P  A  R  F  D  H  M  V  A  E  G  P  R  L  P  C  A  V  S
9548 CGCGGCTGGTCCGTCGTTCGGCGGCGTAGTGCGGCGTAGTGCGCGTAGTGCATGACCGTCGTGCACGAAGTCGTGACCGCGGCC
9640 GTCCGTGTCGACCTCGTCGACCTTGAGCGCCTTCGAGATCGTCGATGAGACCTTCGATGCGGCCTCGTTGATGTGATGCGGGAGCACCCCGGTGCAGGC
      <D  T  D  D  V  E  D  T  M  L  G  E  I  R  D  D  H  N  I  H  H  H  P  L  V  G  G  R  H  L  G
9732 CCGGCAGGTACTGGAGACAGCCGGCTGGACACCGGCCCTCGTCGAGCGGGGTCCAGATGTCAGGCGCGGCCAGGTCATGCGGGGTCCATG
      <P  L  Y  Q  L  C  G  S  S  V  T  A  E  D  L  P  T  W  I  S  L  G  R  R  S  W  R  P  D  M
9824 TACGCCCTCCTGGTCCGCCACGAGTGGGTGCCGCTTGAGGATCGGCCGTAGCGGCGGCTTGAGGATCGAGTTCGTCTCGGGGGAT
      <Y  A  E  D  Q  H  W  P  T  P  A  G  Y  R  P  P  K  L  I  A  H  G  Y  F  D  L  E  D  E  P  I
9916 GTCGAGGAAAGCGGAGGCGATGGCCCGGCATCGCGGAAGTGCGGGTCTCCACCAACTCCGGCAGGTATTTCTCCGGCCGGACGATCTGCG
      <D  L  F  A  S  A  I  A  R  C  R  A  F  H  A  T  E  V  L  E  P  L  Y  K  E  P  R  V  I  Q  P
```

FIG. 11A(9)

```
10008 GGGAGACGGGCAGGCGCGGCCGTCGTCGCCACGGGCCGGCGGCGATGTCCCGGTAGTCGCCGGTGTGTCGCCGGTGTGATCGGGGACGCGGTGATCGGGGAAGAGCCGGTCG
      < L R A P  A A D D G R G A I D R Y D G T D P S A H D A F L R D
10100 TAGGCGGCCCGGAGCCAGGCCGACCTCGGCGTCGTTGCGGCGAGCTGCGGGAGAGTCACGGCCATCGCGGTAAGCCTCCAGCCGACGGTC
      < Y  A A R L W A V E A D D A L Q P L T V F G D R R Y A E L R R D
10192 GACGACTTCCGCACCAACAGTCCCGCCCCAGGGCCATTTGACCACTCTCGGAATAGCCTGTCCGCGAATAAACCATACGGTAGGAACAGCGCG
      < V  V E A G V T G V A M
10282 GCGATACCGTCCCGAGCGGGGAAATAGGGATTCGACTAGTATTCGGTCCGCGCCTGCCAGAACGCACGCGCTCTCGATTGTCCATTCAT
10374 CCCCGTGCGAGACTCGCCTGCCCTCGATGTCCTCGGTGTGGGGGTTTGGGATGACCGGGACACAGCCGCGTCGCGTCGGACGTCGGCGGGGT
      > M T G H S A V A L D V G G V
10465 CGTCTACTACGACGAGCCGTTCGAGCTGGCCTGGCTCCAGGACACCTTCGACCGCCTCCAGGCCACCGACCCGACCCTGGACCTGCGCGCT
      > V  Y Y D E P F E L A W L Q D T F D R L Q A T D P T L D L R A
10557 TTCTGGAGCACGTCGAGCGGTTCTACCACTACGGCGAGGGCGACCCGACCGGCCTCCACTGGCTCCACAGCGAGGCCGCGCTGAGCTGG
      > F  L E H V E R F Y H Y G E G D P T G R T W L H S E A A A L S W
10649 TCGCGGGTCCGGCAGTCCTGGGGCGAGCTGGCCCAGGAGATTCCCGGCGTTCGCGCGTGCCAGGAACTGGCCAGGGAACTACCCGTCGT
      > S  R V R Q S W G E L A Q E I P G A V R A V T R L A R E L P V V
10741 GATCGTCGCCAACCAGCCCCCGAGTGCGCGGAGTACTCAGCCAGGTCTGCCGGGAGGTGCTCCTGGACTCCCTCG
      > I  V A N Q P P E C A D V L A R W Q V S Q V C R E V L L D S L
10833 TCGGGGTGGCCAAGCCCGACCCGGCCCTGCTCGGCCTGGCACTCCGCCGCCTGGCGCTACCCGCCGAGTTGCTGGTGGGCAACCGG
      > V  G V A K P D P A L L G L A L R R L A I P P A E L L V G N R
10925 ACGGATCACGACGACTGTCCTGCCCGGGTCTACACGGAGCTGAGGGCGTTCCGCACCGGCTCCCCGCCGGACGCCCGGGTCACCGTCGCCTGG
      > T  D H D V L P A L G L G C P V A F V L P D P A Y R R P P G V H
11017 TCCCGGACCTGGTCCGGGTCTACACGGAGCTGAGGGCGTTCCGCACCGGCTCCCCGCCGGACGCCCGGGTCACCGTCGCCTGG
      > P  D L V R V Y T E L R A F R T G S P P A D A R V T V A S L
11109 CGGGCCCTGGCCGCCGACTCTCCCCTGACCAGTGCCACGCCCCGCAGCAACGGCGCACGGCGACTTTGACGAAGGAGTGCAGTTGCCGACGCC
      > A  A L A D S P L T S A T P R S N A G T G G L  .
```

FIG.11A(10)

```
11200 CCGCAGCGGTGGTCGGCGCCACCGTCGGCTTCATCGGCTCTCGTCTCCCGCCTCTGGCGAGGCCGGGCATCCGGTGGCGCGCTTCAGCCG
11291 TGCCGCCCCACCGTCGTCGACGGGCTCGACGGGCCGGGGCTCCGCGCGGGAACGCGAGTCGTCTACTTCCTCGCCGCCCGGCTGAGCCGGGCGC
11383 TGGCGGAGCAGCAACCGGACGCGGTCGTCGGGGGACGCGAGTTGTTGCTGGACGTGCTGCTAAGTGCGCTGGACGCGGTGGACCACCGGCCGGTG
11475 TTCGTCCTGCGACAGCTCTCGGCGGGGCGGTGTACACGCGCGGTGTGCGCCGCCTACCGACGGGTGCGGTCAGGCGGTCGGCCACCGAGCCCGCCTCGGCGTA
11567 CGGCCGGGGCAGGCCGAAGCTGCGACCCCGGGTACGGTGTCCTGTCACACTGGCTGGGAGGCCACCGTGCGCGGAGAGCGGATCCGGCTCTTCGGCGATCCG
11659 CGGGGCAGCGGCCGACGGGCGACTACGTACACGTCGACGAGGTCACCGGCGATCATGGAGGTCATCGCGCAGCGGGCCGGTGACGGGCGACCGGCT
11751 GCCGTGGTGCGGGACTACGTCGGCTGGAACGTCTTCCTGCCCACCTCCCTCCGCGAGTTGCTCCAGACGATGTCCACGGTTGCCCGGTCGTGAGCTGGAGG
11843 GCCCACGGTCGTGAACGTCGCCCGGGCAACTGGGCAGTCCGCAGTTGCGACGTCGACACCATGGCTCGCCCGGGAGACCCTGGGCTGCCAGGCGCGGATC
11935 TCATCCGGACGTCCGACGGCGTCCGACGGCGTCCGGCGGCGGGGTTCCCGGCCCGACCGTCAGCCCGGC
12027 AGCCTCCCCGACGGCGTCCGACAGTGCTGGGAGGCCGTCTGGGAGGCCGTCCTCACCCGGCGGCGGGGTTCCCGGCCCGACCGTCAGCCCGGC
                >  S  L  P  D  G  V  R  Q  C  W  E  A  V  L  T  R  A  G  G  P  G  G  S  P  A  R  P  S  A  R
                                                                                                <  .  G  P
12118 TCGGGAGAGCGTCTCGGGGCGGGAACCGCCGGAACCGCGCCCTTCGCAGCAGTTCGTGGCTCAACCGGCGGTCGCGGTGCGCGGTGTAGCC
       >L  G  R  A  S  R  G  R  E  P  P  Q  P  R  P  S  Q  Q  F  V  A  Q  P  G  G  R  R  G  V  A
       >E  P  S  R  R  P  P  P  F  R  R  L  R  A  R  R  L  L  R  H  S  L  G  A  A  T  A  A  T  Y  G
                                                                                               junction marker
12210 GAGGGCCAGTGGCAGGGGCGAGGGCGAGCCGGATTCCGGGGCCGGTACGGTGGCCGGTCCCATTCCTTGGCGCAGGCCGGTGCCTGGTTCCGTCCGG
       >  E  G  Q  W  Q  G  E  P  G  F  R  G  R  T  V  P  V  P  F  L  A  Q  A  G  P  C  L  V  P  S  G
       <  L  A  L  P  L  A  L  R  S  E  P  A  T  R  H  R  D  W  E  K  R  L  G  A  R  A  Q  N  R  G  A
12302 CCTCGCACCGCCCGCCCTGCCAGTACGCCCGCCAGCAGGTACCGGGGGGGTCAGCCGGCCCGGGTCGATGTCATGGGTGACC
       >  L  A  P  P  L  P  V  R  P  P  Q  Q  V  P  G  G  Q  P  A  R  V  D  V  M  G  D
       <  E  C  R  G  Q  W  Y  A  R  R  L  L  Y  R  P  T  L  R  G  P  D  I  D  H  T  V
12382 GCGTGGTCCGGAGCAGTTGCTCGCGGGGCGCCGCCTTCATGGCGCTCATGAAGGAGGTGTCCTCC
       >R  V  V  R  E  Q  L  L  A  G  A  G  G  L  H  G  A  D  E  G  G  V  L
       <A  H  D  P  L  L  Q  E  R  A  G  A  A  K  M  A  S  I  F  S  T  D  E
```

FIG. 11A(11)

```
12451 CCTGACTGGAGGGTTGCCCCCGGTACGGGCTGAGGGCCAGGTCGAAATCCAACCGTGGGCGTGCCGGAAC
      >P .
      <G   S   Q   L   N   G   G   T   R   S   L   A   L   D   F   D   L   G   H   A   H   A   F
12520 GCGGAGTCCACCCCCATGCACGCGCCCCAGATCTTGATGTTTCCCTGGTCACGGTGCCAGCTGGAACTGGCCGGA
      <A   S   D   V   G   M   C   A   G   W   I   K   I   N   G   Q   D   R   H   W   G   V   L   H   F   Q   G   S
                                       junction marker
12603 GGTGACGTACCACGGAGACGCAGCGCGGGCGGGCCAGCCGGGTGCCGACCACGTGCCGCGTCGCGCAGGCTCTTGCGGACGGCGTCGA
      <T   V   Y   W   P   L   R   L   A   P   R   A   L   R   T   G   V   V   H   A   G   D   R   L   S   K   R   V   A   D   V
12695 CGGCAGCGGCGTCGAGCCGCACGTGCTGTCGACGAACATCAGATGGTGGTTGCGGCAGCGAGCATCGCGTTGCGGGAGGCCGACAGG
      <   A   A   A   D   L   R   V   D   D   D   V   F   M   L   H   H   P   W   R   A   L   M   A   N   R   S   A   S   L
12787 CCATTGGTGCACCGAGGATGCGCAGCTGGTGCCGCGGGCCATGTGTGCGGAGGTTCTCCACCGGAACGCGCAGATCGCCACCA
      <G   N   T   A   G   L   I   R   M   T   G   G   A   A   R   V   E   E   A   E   A   T   V   P   R   D   L
12879 CAGGACGTAGTACTCGTCGCCGAGACGATCGGGCTGACGCTGTTCGGCATCGTCCCTGACATGAGCGTTGTGGGCCGGCGGGGAGA
      <   L   V   Y   Y   E   D   G   S   L   Q   A   M   N   H   A   L   H   K   R   V   N   E   V   R   F   A   C   I   A   V   V
12971 CCATCGGGTGGTCGGACGGATCGCGGGCGCTGACGCAGGCCGTTGTTCGGCATCGTCCCTGACATGAGCGTTGTGGGCCGGCGGGGAGA
      <   M   P   H   D   S   P   D   R   S   V   V   S   A   N   N   P   M
13061 GGCGGGCCCACCGGATCGCCTCCGCGGCAGCGTGCCGCGGCCGCCCCGGCGACCAGGTGGCCGCCACGCGCAGCGCGGGGCGTCCGG
13153 TGAGCGGCGGGGCGGAGCTCAGGCGGGCCCGTGTCGTCCTTGCCGCGCTTGCGCAGCGTGCCGCGCGAGGATGCCCATCGCGTACGCCTT
13245 CGCGAGTCAGGGCCCGGCCGGATCCGGTTGGGCACTCGCGCGGCCGGTTCTGCAACAGCTTCGCAAGCTTCGACGCGTGCTGACGGCTGAGGTAGACCTTGT
13337 TGGGCGATATGCAGGGCCGATCGTCCGCTCGCCGCGGCGATGCTTCGATGATGCGCGTCATCGCGCCCCCTGAGGTGCCGGTGGACGAGTGGTGCCTTCCGCT
13429 CCTTGATTGTGTGATCTGTTGGCTCGTCGTGCGCGGGTGCCGGGTCAGCTGGAAGGCCGGGGATGGCCAGCGGAGGAACCAGCGCCCCGGCACG
13521 GGAAGACGGTCAGCGGCGGAAGGCCGGGCTGCCGTGCGGGCGGGCGCTTGGCTGCTTCGGCAGCGTGTCTCAGCAGCAACCAGCGGAGGAACATTGAGTTTC
13613 TAGCCCGCCTTCGCTCGTCGATCGACATCACTGGGCGAAATGAAACCGACGGATTCGAGCGAGCCGATAGTTACGGAAAGTGACAATCGGCTGGCC
13705 GAAGCCCTTCGCTCGTCGATCGACATCACTGGGCGAAATGAAACCGACGGATTCGAGCGAGCCGATAGTTACGGAAAGTGACAATCGGCTGGCC
13797 CTGTCGCTCGCGCTGAACTCACCAATACGCCAAAAGCGTAGCCGGCCGGTCCACCCCCGAGGAGATATCGCCAGGCTTCCATG
```

FIG.11A(12)

```
13889 CAGAACTGGCAGGATCTTTCATCTCAGCCGCACCTGGGCGACAAACCCCTGCTCAAGACCATGAGTAAGCAGGCGCGGGAAATCCATGCAGT
13981 GACATGTGTCACTTTAGACAACCAGTCCAGCTCCAGCAGGCCCCACCACCCTGACAAAAGGGGCGGAATGCGACCAGAGCGACACCAGCATTC
14073 CTAGGGATTCCTTAGTCTGGCGAGCGTCCGCAATGCAGCGTCCGGAACGACGAGGTCCACCCCGTCAATCAATTGCCACGCGTCAAGATCAACCACTCCG
14165 CACCGTGAGGAGGCCGACGTCCGGCAATGCAGCGTCCGGAACGACGAGGTCCACGCGCTAGCCTCACGCGCTGGGGGGCCGGCACGGGCCGGA
14257 CACCGTCCGGCGTCGTGATCAGCGGGGTCGCTCGCGTGTCGCCGGGCATCGCGGCGGGGGCATCGCGGCGGGGCCGGCACGAAGATCTCCG
14349 GCGACCTGTCAGCCCTGCAAGCGGACCGGGACCGGGACCGGGAACCGGAACCACCCGACGGTTCAGCGCGGGAAGCCGACT
                 <  .  R  R  S  R  D  P  L  R  S
14440 CGCGGCCCTCGTCCCAGAGCCCGCCTCCAGAGGCCATCCCGCAGCGATCGTCGGGGCGCGCCACCCGAGCAGGTCACGCGCGGGGTCGACGC
         <  A  A  E  D  W  L  G  G  V  A  D  R  L  S  R  R  R  P  R  W  G  L  L  D  R  A  P  G  P  D  V  R
14532 GGGCCCAGTCGACGACCTCCACGGACCGCGGGCCGATCGGTCGGCCAACTCGGTCGCACCACTCGGTCGGCAACTCGATCAACATCTCCACG
         <  A  W  D  V  V  E  V  S  G  P  R  D  P  L  E  V  V  E  T  P  V  G  S  V  E  I  L  M  E  V
14624 AGGGAGCGGAACGGCCTCCCCCCGCCGATCAGCGCCATCACCGCGGTGGCCGACGACTCCCGCGCTGGCCGACCACCGCGCTCGGCGAC
         <  L  S  R  V  P  V  A  E  G  R  G  V  G  I  V  R  G  T  V  S  E  R  T  A  S  V  V  A  E  A  V
14716 GTCCCGCACGTCGACGACGTCGACGTAGTCCGGCTGGGCGCGCAACGAGACAACTCCACCCTGGCCGACGGTCGGCCCGCCGCTCGACCAGGCGAA
         <  D  R  V  D  V  Y  D  R  H  A  R  L  P  S  L  E  V  R  A  S  R  D  R  G  A  A  D  V  L  R  V
14808 CGAACGAGACCGCCCAACAGGGTGCTGGCACGCCCAGCTTCGCCTGGCCCAGCTTCGCCTGGTGGGGCACCGTCGTGCACCGGTGGGCGCGGCACACCTGGGCACCGTGCACCGGTGCACCGTCGGCCGCCGCGGGGCCGGGGAGCCCC
         <  V  V  R  G  L  L  S  D  P  P  V  G  P  G  V  V  N  A  L  R  L  V  T  A  D  V  S  G  A  R
14900 GTCGCCGGCGAGCAGCGGCCCTGGGTGGCGGCCAGCTTCGGCGCGGTCGCCCTGGCCTCTCCGGCTGGGCACCGTCGTGCACCGGTGTAGCGCCCGGTGTGCCGGTGACACTCCACG
         <  T  A  A  L  V  A  Q  T  A  A  L  K  A  R  G  Y  M  S  E  P  Q  T  P  V  T  A  G  A  P  A  G
14992 GGGTGGCCTCCTGGACGCCGTTCCAGGACCGAGGTGCGCCAACGGCTGGGCCGGCAACGGGGTGCCGCCGGTGCGCCGGGTGACACTCCACG
         <  P  P  E  Q  V  R  E  L  V  S  G  L  H  V  L  R  P  R  C  R  T  R  E  L  A  A  T  V  S  W  T
15084 TCGGGGATCGTGTGCAGTCGAGCGGCTCGGGCGCAGCGTCCGGCAGGTTCCACTTGCCACTTGTTGACCACCGCGTTGGCGTTGACCCGCGTCGGCGTCG
         <  P  I  T  C  S  S  P  L  E  A  D  T  L  N  W  K  G  G  T  A  N  V  V  A  D  P  Q  E  A  D
```

FIG. 11A(13)

```
15176 AACACGGGGCCAGCGCGGGGCTCCAGGGTGGGCGACGTCCAGCGCCCGGGCCCGGTACGGCAGCCCCGACGGGACGCGGGCCAA
      <F  V  A  A  L  A  A  P  E  L  T  A  V  D  L  A  R  A  R  Y  P  L  G  A  S  P  V  R  R  A  L
15268 CACGAGGACGTCGTGCGCCCCGGGCGGCAAGCGGCGGCGCTCACGTACCACCCGTGACGCGAAGCCCGTACCACCGACGACAGGCCCGCGCGC
      <V  L  V  D  D  G  R  A  A  L  A  A  S  V  H  R  G  V  F  G  T  G  G  V  V  V  R  R  A  G
15360 CCATCCGTACCTCCTGGGATCAGTCTGTGCCGCGGCGTCCAGGCGACGCCCTGACGCGACCAGGTCACGGGGCGCGCAACAC
      <M  .  D  R  A  G  A  A  D  L  R  G  G  P  G  Q  C  T  V  P  A  R  L  V
15449 CCTGGCCCGGTCGCGAACCTCGTCCACGAGCCCGGGCCCGGATCGCCTCCTCCGCGGTCACCTCCTCCGCGGCTGACGGCGTGACGGCGGGA
      <R  A  R  D  R  V  E  D  L  L  R  A  R  A  R  I  A  T  V  E  E  A  P  Q  G  A  T  V  A  R  V
15541 CGAACTCTCGCATCGTGTTGACGAACTGGTCCTCGCGCCGGAAGGTCAGCTCCCGCGTTCTGCGCTCCTGCGTCTCGTCCTCACCCGGGTGC
      <F  E  R  M  T  N  V  F  Q  D  E  A  P  F  T  L  E  R  T  E  D  Q  R  E  V  R  V  V  P  H
15633 CAGGCCCGGCGGTGGGGTGTACGCCGGTCGACGATCCGGCCGGCTTCCCCAGAGCTGGTACTCGACGGTAGGAGTGCTCGAAACC
      <W  A  P  P  P  T  Y  A  R  D  V  V  I  R  G  A  S  G  W  L  Q  Y  E  C  R  Y  S  H  E  F  G
15725 GAAGGCGATCTGTGCGGGCCCGGCTCCTCCGGACAGGACGCAGGCGGAAACCGCGGCGATCGGGGTCCTCCCGGAGGTGG
      <F  A  I  Q  A  T  R  G  D  P  T  C  L  L  A  A  G  S  V  D  V  G  R  D  P  D  E  R  L  T  A
15817 CCGCCACCACTCCGGCTCCTCCGGACAGGCAGCCAGATGCCAACGGGTAGAGCGCGCCAACGGGCTCCGCCACCCGCCCTCG
      <A  V  V  E  P  E  E  P  L  F  F  R  A  A  G  L  P  Y  V  G  L  D  L  L  A  G  G  L  E
15909 GGTCGGTAACGATGTCGACGAGATGCCGAGGACCAGGCAGGCGGAAACCCGGAGACGCCGGAGACCATCGCCGGATCTCGCCGCGGACCAT
      <P  R  Y  R  I  D  G  A  P  L  P  P  F  G  F  V  G  S  V  M  R  L  E  G  I  E  G  A  A  V  M
16001 CCGGCGCACGAAGTGTGCACCCCATGTGCTCGAGGAAGGTGAGGTTGTCATCAACAGCGACCCGGGCCTGGGTCAGCAGCACCGCCG
      <R  R  V  F  H  H  V  G  H  R  L  F  T  L  N  D  M  L  V  L  G  R  S  R  A  Q  T  L  V  A  A
16093 CGGTGTCGACCAGCAGCGGGTGGTGGGTGGTGGTGCTCAGGCGCTGTTGCCGCGGCCAGGGCGCGTTGATCCAGGTGTGGTGCAGCCCG
      <T  D  V  L  R  T  T  L  P  K  E  V  L  V  H  K  G  A  A  L  A  R  E  I  W  T  H  H  L  G
16185 GTCGGCAGCGGAATGTAGAGCGGCATCGATGTCCGGGGCGGTCGAGAACGGACTGGTAGCCCTCGGCGGCGGACTGGAAAACGCCGGCGAA
      <T  P  L  P  I  Y  V  A  D  I  D  P  R  D  L  V  S  Q  Y  G  E  A  A  A  C  G  F  E  A  A  F
```

```
17379 GCCACGGTGCACCCGGGTGTAGTTGCTCCGGGTGGCCTGCACGTCGGCGAGAGCTGCATGACGTTGATGTTGCCGGGCTCCACCTTGGCCT
      <G R H V R T Y N S R T A Q V T P S L Q M V N I N G P E V K A Q

17471 GGAGCAGGCAGTACGGTGTCCCGTCGACGACCTTGACGAGCATGCCGAGGATGCCGATCTCCGGCTGGTTGATGATCGCTGGTGCCATTCG
      <L L C Y P T G D V V K V L M G L I G I E P Q N I I P Q H W E

17563 CGCACCGCGCCGTAGGTGGTCTGCAGCGTGCACGGGTTGAGTAACGAGAAGAACCGGCCGCTCTCGTGCCGAGGTTGCCGGTCACCGGGTCGAA
      <R V A G Y T T Q V H L G E I V F F R G S E H G L N G T V P D F

17655 CGCCCACCCGGCAGCCGGGTCCAGGCACGGTCGCAACGGCGACTAGGTCGACCGGGCGAACCAGGAGGAGAAGTCCGGCC
      <A W G P L R D L P V R D V E C Y T S R T R E A F W S L F D P R

17747 GGACCCCTCGGCGTGCAACGCGACCACGAGCGCGTCGACGGGCCGGTGCGGGGCGGDVPG PRHPGADRTLLPGD
      <V G E A H L A S W S G G D V P G P R H P G A D R T L L P G D

17839 GCGCGGACCTTCGGGTCGGGCGACGAATGCTCACCACAGCTCGGCCAGTTCGGCGGAAAAAGGCGTGGGAAGACCCGTCGTCCGCCAA
      <A R V K P D P S S D S V

17930 CAGGCGCAGATCGCTGTCGACCATCATGGGCGACCATCTCCTCGAAGGAGACGGAGGGTTTCCAGCCGAGCCGCTGGCGGGCCTTCGTCGGAT
      <- W L E A L E A S F A H S S G D T D A L
      <L R L D S D V M M A V M E E F S V S P K W G L R Q R A K T P D

18022 CCGGCGCAGAGCAGCTCGACCTCGGCGGGGCCGGAGCCGGTGCCGGCGATGAGCGACTCGTCCACCACAGGTCCCGCCAGTTGAGGCACGTGGGCGAAGGCC
      <A C L L E V E A P R I L S E D V V V H D R W N L G V H A F A

18114 GCCTCGACGAGAGCTCCACGAACAGTGCGTGTGCCGGTGACCCTGTCCGGCGAGAGGTTGCCGGCGAAGCGAGCTGCGAATGCCCAGTTCACCGCCACGC
      <A E V L E R V S H T V G T G L V Y D E P E D Q A L M L V M G R

18206 CACGTAGTCGCCCGCGAAGCCCAGTCGCCGGAACTCGGACGAACGCCTTGCGCCGCGCCGTAATGCCGAACGCCGTACGGCGCTACGAC
      <V Y D G A F G W D R E A S L N G L R L S S R I G L K V A A V G

18298 CCAGCGACACCTTGCGGGTGACGAACTCGGACGACCACGGTCGATTCGTTGGTTGAACAGAATGCCGGAGACGGCATACATGCCGTACGAC
      <L S V K R T V F E P G R V P S E H N F L I G S V A Y M G Y S

18390 TCACGGTAGTTCTGCACCATGTAATGCCGAACGCCTTGGCCGCCGCGGGTACGCGGTACGGGCTACGGGATGGAACGGGGTCAGCTCATTCTGACGGG
      <E R Y N Q V M Y H G F A K A A G Y P S R P H F P P T L E N Q V P
```

```
19768  CGACCATGGGCCCTGACCATGGTGGCGGGGCCCGCTCGTCGGGGCCCTGATCACCGATGAGCTCGGCTGGTGCTTCTACATCAACCTG
      >A  T  M  G  L  T  M  V  A  G  P  L  V  G  G  L  I  T  D  E  L  G  W  R  W  C  F  Y  I  N  L
19860  CCGATCGGGGCGGTCCGCTGCTCATCGTGGTGCTGATGATGCACCTGCCGCGCCACAAGGCCCGACACTGATTACGCGGGTGCTGC
      >P  I  G  A  V  A  L  L  I  V  V  L  M  M  H  L  P  R  R  H  T  K  A  R  I  D  Y  A  G  A  A
19952  CCTGCTCACCGTGGTCAGTTCGCTGTCGTCGTGTGCTGTGACCACTGGCATGCCGAGCGTCTCCGATGATCCTGGGGCTGG
      >L  L  T  V  V  S  S  C  V  V  L  V  T  T  W  G  G  I  T  Y  P  W  A  S  P  M  I  L  G  L
20044  TCGCGCTCGGGGTGCTGACCTGCGCGCTCTTCGTGGTGGTGGAGCGCGTTGGTGCCCTGGCCATGTTCCGGCAGCCTG
      >V  A  L  G  V  L  T  C  A  L  F  V  V  E  R  R  V  A  E  P  L  V  P  L  A  M  F  R  S  L
20136  AACTTCACCCTGAGCACCCTCATCGCCTTCCTGGTCGGCTGCTTCGCCCTCGACTTCCTGGCCCTGTTCCAGCAGGCGGTGCA
      >N  F  T  L  S  T  L  I  A  F  L  V  G  F  A  L  I  A  G  L  T  F  L  A  L  F  Q  Q  A  V  Q
20228  GGGTGCCTCCGCGTCCGACTCCGGGCTGCTCCTGCCCCTGCTGTTGTCCATGGCGGCGGTCAACGTGCTGCTCTTCGCCCTGATGGACGTGGGCACCAGC
      >G  A  S  A  S  D  S  G  L  L  L  P  L  L  L  S  M  A  A  V  N  V  V  G  G  R  L  M  S
20320  GCGGGCCGTTCCTACCGGCTGCTGATGCTCGCGGGCGCTTCGGCGCGCGCAGGGCTGGGGGCGCTGGGCCTGATGGTGGCGCTGAGCAGCGTGGAA
      >G  G  R  S  Y  R  L  L  M  L  A  G  A  A  L  M  T  L  S  L  L  L  F  A  L  M  D  V  G  T  S
20412  CGGACACGGTCACCGCGGATCCCCATGGTCGGCTTCGGGGCTGGGCTCGGCCTCATGCAGACCAGCCTGATGGTGGCGCTGAGCAGCGTGGAA
      >R  T  V  T  A  I  P  M  V  G  F  G  A  G  L  G  L  L  M  Q  T  S  L  M  V  A  L  S  S  V  E
20504  GATGAGGAACCTGGGGGTGCAGTCGGCGGCCTGGCCGCTCTTCCGCACGTCCGCACTCTCGGCGCTGGCCACTCTCGGCGACGTCTCGCTGTTCT
      >M  R  N  L  G  V  A  A  S  T  S  T  L  F  R  T  I  G  G  A  V  G  A  S  A  T  V  S  L  F
20596  CCGTGCGGGTGCAGTCGGCGCTGGCCGATCGGGGCGTGGCGGATGTGGCCGATCTGCTGGGCCACTCCGCGCGCTGGACGCGCTGGGGGCTG
      >S  V  R  V  Q  S  A  L  A  D  R  G  V  A  D  V  A  D  L  L  G  H  S  A  R  L  D  A  A  G  L
20688  GCCCAACTCCCCCGGGCCGTCCGTGTCCACTTCATGCACGCCGTTCCTGGCCTTCCTGATGACCGTGCTGGCGGGGCT
      >A  Q  L  P  R  A  V  R  V  H  F  M  H  A  V  A  S  G  T  R  W  A  F  L  M  T  V  L  A  G  L
20780  GATCTGCGTCGCGGCGGCGTGGTTCCTGCGCCGGGTCACCCCGTTGACGTCGGCACCGGAACCGGCGCGGCGACGTCGCCGCC
      >I  C  V  A  A  A  W  F  L  R  R  V  T  P  L  T  S  A  P  V  A  P  E  P  A  R  D  V  A  A
```

FIG.11A(18)

```
20872 CCGCCGCCAGCAGGCGGGCGCGCCGGAATCTAGCGGATTCCTAGGGTTCCTCGTCGACGGTAGAGCTGAATTCACCGGCGACTAACA
       >P  A  A  S  S  G  R  A  P  N  Y  .
20963 TTCTTTCGGATCGGAATCCGTCCATTCCCTGTCTCGGATGGTCGACGGGCCGGGCCCGTGCCGAGCGGAGACAGAGATTCTCGGAT
20055 TGGAGCTGCGATGTCCAGCAAGATCCTAGTCATCGGTGGAGGTCCGGCGATCGGCCCGATCGCTCGCCCGATCGGGGCTGTCG
        >M  S  S  K  I  L  V  I  G  G  G  P  A  G  S  T  A  A  L  L  A  R  S  G  L  S
21145 GTGACGCTCCTGGAAAAGGAGAGAGTTCCGCGATACCACATCGGCGGAGTCGCTCGTCGCGACCATCGTCGATTCGTGGGCGC
       >V  T  L  L  E  K  E  T  F  P  R  Y  H  I  G  E  S  I  A  S  S  C  R  T  I  V  D  F  V  G  A
21237 TCTCGACGAGGTCGACTCGCGGGGCTACCCGCAGAAGAACGGGGTTCCTGCTGCGCTGGGCAAGGACTGGGCCATCGACTGGGCCAAGA
       >L  D  E  V  D  S  R  G  Y  P  Q  K  N  G  V  L  L  R  W  G  N  E  D  W  A  I  D  W  A  K
21329 TCTTCGGTCCGGGCGTGCGTCCTGGCAGGTCGCAGGTGTTGTTCGACGGGTGTTCGACCCGGTTGAGCGGAGTCGGTGAGGTCCGCAC
       >I  F  G  P  G  V  R  S  W  Q  V  D  R  D  D  F  D  H  V  L  L  N  N  A  G  K  Q  G  A  K  I
21421 ATCCAGGCGGCGGTGAAGCGTGTCAAGCGGTCGACGCGGTCGACGCCGGGCCGGGCTGATCCGTCCCAGCACTTCAAGCACCGGAGACGTTCA
       >I  Q  G  A  A  V  K  R  V  L  F  D  G  E  R  A  T  A  E  E  W  F  D  P  E  S  G  E  V  R  T
21513 CATCGATTTCGACTACGTGGTCGACGCTAGCGGCAGGGTGGCTCGCTGCTGCCGAACTCTCCCGGCGGGATCAACGTCATCTCCGCCCGACGGC
       >I  D  F  D  Y  V  V  D  A  S  G  R  A  G  L  I  P  S  Q  H  F  K  H  R  R  P  T  E  T  F
21605 AGAACGTGGCCATCTGGGGCTACTGGCAGGGTGGCTCGCTGCTGCCGAACTCTCCCGGCGGGATCAACGTCATCTCCGCCCGACGGC
       >K  N  V  A  I  W  G  Y  W  Q  G  G  S  L  L  P  N  S  P  S  G  G  I  N  V  I  S  A  P  D  G
21697 TGGTACTGGGTCATTCCGCTGCGCGGCGACCGGTACAGCATCGGCTTCGTCTGCCACCAGAGCCGCTTCCTGGAGCGGCAAGGAGCACGC
       >W  Y  W  V  I  P  L  R  G  D  R  Y  S  I  G  F  V  C  H  Q  S  R  F  L  E  R  R  K  E  H  A
21789 CTCGCTGGAGGACATGCTCGCCGCACTGGTACAGGAGTCCCCGACCGTGCGGGGCCTGACCGCGAACGGCACGTACCAGCCGGGCGTGCGGG
       >S  L  E  D  M  L  A  A  L  V  Q  E  S  P  T  V  R  G  L  T  A  N  G  T  Y  Q  P  G  V  R
21881 TGGAGCAGGACTTCTCGTACATCTCCGACAGCTTCTGCGGGCCGGGCTACTTCGCGGCCGGGGACTCCGCCTGCTTCCTGGACCCACTGCTG
       >V  E  Q  D  F  S  Y  I  S  D  S  F  C  G  P  G  Y  F  A  A  G  D  S  A  C  F  L  D  P  L  L
```

FIG.11A(19)

21973 TCCACCGGGTGCACCTGCCCTCTACAGGGGCATGCTGGCCTCGGCGTCATCCTGGCCACCATCCACGGTGACGTCACGGAGGAGGAGGC
     >S T G V H L A L Y S G M L A S A S I L A T I H G D V T E E E A

22065 GCGGGCGTTCTACGAGTCCCTCTACCGCAACGCTACCAGCGCTGTTCACCCTCGTCGCGGGCGTCTACCAGCAGGCCGGCAAGAGGG
     >R A F Y E S L Y R N A Y Q R L F T L V A G V Y Q Q A G K R

22157 CATACTTCGGCCTGGCCGACGCGCTGGTGCACGACAGCGGCGAACCGGAGTACGAGAAGGTAGACGGGGCCCGCGCCTTCGCCCAGCTCGTC
     >A Y F G L A D A L V H D S G E P E Y E K V D G A R A F A Q L V

22249 GCCGGCCTCGCCGACCTGGACGACGCGGCCGAGGGACGGCACGACAGCACCGCGGCGGCAGCGCCGGCGGAGCAGGACAACTCCGTCCGGCA
     >A G L A D L D D A A E G R H D S T A A A A P A E Q D N S V R Q

22341 GCTCTTCCTGGCCGCCGAGGAGGCCCGGCGGATGGCCGACCGCACGCCGAGCGCCCCGGTCAGCGAGGCCCCAAGCTCGACAGCC
     >L F L A A E E A R R M A D R T P S A P V S E A P G K L D S

22433 ACGACCTCTTCGACTCGGCAACCGGCCTCTACCTGGTCACCCCTCGGCTGATCCGCCGGGCGAAGCCGGCCGACACGCAGGCGGCG
     >H D L F D S A T G L Y L V T T P R L G I R R A K P A D T Q A A

22525 GCAGAGCAGTCTGCTGAGGTTCCACCCCTGTGGCCCGGAGGGCAGGGCCAGGCCGAGGGCTGCTCAACCCTCCCACCAACATCCG
     >A E Q S A .

22616 GCATCCGGGTGCCCTCGGCAGCGTGGCCGCCGGTGCTCCCGGAGGCACGCGTCATGTCACGTCCTCAGACGGGACGCGCAGGCGGCACCGGC
                                                >M S R S L R R D A Q A Q A P A

22708 GTTGCTGCCCTCGGCAGCGTGGCCGCCGGTGCTCCCGGAGGCACGCGTCATGTCACGTCCTCAGACGGGACGCGCAGGCGGCACCGGC
     >V A A L G S V A A G A P G G T R S C H V P Q T G T R R R H R

22798 GTCGCCGCCAACCGGCAGCCCCGGTCGTGCCGCCGGGCACGCCGGGGTCAGCAGGGTCAGCAGCGTCACGACCACGTCGGTCACCCGTTCACCGAGCCGA
     >S A A N R Q P R S C R R A R R G Q Q G Q Q R H D H V G H P F T E P

22890 TGCCCCGTCCCGCGGCTGACCCGCTCCGCCCGGTCTCCCGCCGGCATGCAGCGTCTACGACGTCTACGAGATCCCATCCGGCCGGCAGGTGCAGATCCTG
     >M P V P P R L T P V S R R D G I D V Y E I P I R P A Q V Q I L

22982 CCCGGCCTGCTCACGCCGGCTTACACCTACGGCGCCTTCGTCGGCCCACCATCCGGGCCCGGTGCGGATCACCTA
     >P G L L T P A Y T Y A G S F V G P T I R A R T G R P V R I T Y

23074 CACCAACGGCCTCGACACCCACGCCAACGTGCACCTGCACGGCGGGCACGTGCCGGCCACCAGCGACGGTCACCCGATGGACCTGATCCCGC
     >T N G L D T H A N V H L H G G H V P A T S D G H P M D L I P

FIG.11A(20)

```
23166 CGGGCGGGCTCGAAGGTCTACGACTACCCGAACCTTCAGCTGCGGGCGGGACGCTCTGGTACCACGACACACCCACGCCTACGAGGCCGACCAC
     >P G G S  K V Y D Y P N L Q R G A T L W Y H D H T H A Y E A D H

23258 GTCTACCGCGGACTGCACGGCTTCTATCTCATCGACGACCCGGCCGAGCATCACCTGCGCCTGCCCGCCGGCAAGTACGACGTGCCGATCAT
     >V Y R G L H G F Y L I D D P A E H H L R L P A G K Y D V P I M

23350 GCTGCGCAACGCCCAGTTCGACGACTCCGGCGCCCTCGTCTTCGGCCACCCGGACGACCGGGTCACCATCCTGGCGAACGGCAAGGCCCAGC
     >L R N A Q F D D S G A L V F G H P D D R V T I L A N G K A Q

23442 CCTACTTCGAGGTGGCCCCGCGCAGGTACCGGTTCCGCCTGCTGAACGCGCTGAAGCACGTCTTCCGGCTCAACCTGGGCGGCGAACCG
     >P Y F E V A P R R Y R F R L L N A A L K H V F R L N L G G E P

23534 CTCACCCGCATCGCCACCGACGGCGGCCTGCTGCCCGCCCAGTCCCACACCGAGCTGCTCCTCCGGGGAGCGGGTCGAGATTGT
     >L T R I A T D G G L L P A P T S H T E L A L S S G E R V E I V

23626 GATCGACTTCGCCGAGCACTGCCCAGGCGGGGCCGGGTCACCTGCGCGCACTGCCCCGATGGCACCGGATGGCACCGTGTCGATGAGCTTCGAC
     >I D F A E H A G G G P V Y L Y D G D N P I L R F D V S S R A

23718 TCACCGACCCAGCCGGGTCGCCGGGTCACCTGCCGGGTCACCTGCCAAACCGTTCGACCTCTCCGGGGTGGACGTACAGGTCAAGCGGGCAGCACCGAGAT
     >V T D P S R V P V T L R A L P P M G T P T V E R T V S M S F D

23810 ATGTCGGCGCGGCCCCGATCGCGCTCATGGACGGCAAACCGTTCGACCTCTTCGACATCCGTTCCACCTGACGTTCCGGGTGCTCGGCCGGACG
     >M S A R P P I A L M D G K P F D P L R V D V Q V K R G S T E I

23902 CTGGAACGTGGTCAACGCGGATACGGACCCGTTCCCCTTCGACCATCCGTTCCACCTGCACCTGGTCACCTTCAGATCCAGGTCACCTTCGCCACG
     >W N V V N A D T D P F F D H P F H L V T F R V L G R D

23994 GCGGGGCCCGGCCCCGGCACCCGGAGGACGCCGGGCTCAAGGACACCGTCTACGTCTCGCCCAAGGGCTCTGTCAAGATCCAGGTCACCTTCGCCACG
     >G P P A P E D A G L K D T V Y V S P K G S V K I Q V T F A T

24086 CCGTACCTCGGGCAGTACGTCTACCACTGCCACTACCTGGAGCACTCGTCGCTGGGGATGATGGCCCAGCTGGAGGTTGTGCCCTGAGGGC
     >P Y L G Q Y V Y H C H Y L E H S S L G M M A Q L E V V P .

24177 TCAGCCGTGCAGGTCGACGATCGAGGGCGTGGGCCGCCGAACAGGCTGACCGGCCACGTCGCCCGAACCGGCCGCGGGGCCAGG
     <. G H L D V I S P H A G F L S V P R V D G V G F G A A R A L
```

FIG. 11A(21)

```
24268  TCGGCCTGGTCGGCGAACTCGTGCAGCAGTACCGCCGGGCCCGCCGTCGACCGGGCGCAGCTCCGGCGAAGAGGCGGCCGGAATC
        D  A  Q  D  A  F  E  H  L  L  L  V  A  R  G  G  D  V  T  V  R  R  L  E  A  F  L  R  G  S  D
24360  ACCGGCGAGCACGCCCCGCCTGCCGGTCCCAGGGCGGATTGTGACCACCGGTCGCAGCGGCAATCGTC
        G  A  L  V  G  R  A  Q  V  Q  R  D  W  P  P  N  S  V  V  R  D  V  R  G  T  R  L  P  L  R  G
24452  CGGCGTCGGCGACCGCCAGGTGACGGGCCCCCGAGTTGGCGCCGACGCGTCTCCGGGTCGTGGTCCGAGCCG
        A  D  A  V  A  W  T  V  R  A  G  S  A  A  S  N  A  V  A  A  G  V  T  E  P  D  H  D  S  G
24544  AACAGCACCGCCCCGGTGCCAGCCCTGGGAGCCGCGGGAGCCGATCGTCGCCAGCACCAGCATCCGGGGCGGAT
        F  L  V  A  G  P  A  L  G  A  A  E  V  P  I  T  G  T  G  C  C  P  D  A  V  L  M  G  P  R  I
24636  GCCGGCCAGCCAGGCCAGCGCGCGGCAGCGGCGGATGCAGGGTCCCCGGCGTGGAGACGACGCTTGTAGGCCCGGTGCAGCGGCCGGT
        G  A  L  W  A  L  A  A  A  L  P  P  H  L  T  G  P  T  S  S  R  K  Y  A  R  R  H  L  P  R  D
24728  CGGCCACCGGTACCGCCAGCGTGCCCTGGGTGCCCTCGAGGTGACCCGCCAGCGACACCGCCGCCTCGCCGCCGCGGCGG
        A  V  R  V  A  L  T  A  Q  T  G  E  V  T  V  R  L  S  L  G  G  E  P  P  A  E  G  G  R  R
24820  GAGTGGTAGCGCAACCCGAGCGCGGCCACCGCGTGCCGCCCACGGTCGTCCTGATGTCGTAGTTGCGGCGGAGGAAGGA
        S  H  Y  R  L  G  L  A  A  V  A  H  R  G  V  A  D  E  I  D  Y  R  N  Y  N  R  R  G  L  F  S
24912  GGGCGCGACGTCCACGGTCCAGGGGCCGCCGGTGTGCCGGGCGCCGGAGACGCCGGCCAGCC
        A  A  V  D  V  T  A  P  R  G  P  V  G  C  A  A  R  A  P  L  V  A  P  L  A  A  A  R  A  L  R
25004  GGGTGAAGGCCCGGCCAGGTCCGCCTTGGTGCCGGCGCGTCGGCGGACGGCGAGGAACAGGTCGTCGACGTACGCAGATCAGC
        T  F  A  A  L  D  A  K  T  H  G  V  G  D  A  V  L  L  F  L  D  D  V  T  R  L  D  L
25096  AGGCGCGGCTCCGCGCTGGCGGCGCTGGGAGAACACACCTCGCCGGTGCCGGCGGTGCTGACCGGCCCGGAGGCCCGGGCTCCTCGATCTCTGGGC
        L  R  P  E  A  S  A  A  S  F  W  V  E  R  H  R  H  E  V  R  G  L  G  R  E  E  I  E  Q  A
25188  GGCCACCTCCTCCAGCCCTCGCAGGGTCCGTGCCATGAAGGCACCGTCCGCGATCCTCCTCCCGCCGGGTCGTCCGCCGCC
        A  V  E  E  L  G  R  L  T  R  A  M
25278  GTGCCGGCGGCCAAGACTAGTGAACCTCTATAGGAATTCGCGTGCCCCCTTCATAGGGTCGCCGACCGGCGACGGGGGAGCCGACGCCGA
25370  CCCGGACCCGCCGGACCGGTCCGGCACCGGA
```

FIG. 11A(22)

```
25462  CGGCTCGTGTTTCTTCCCCAATTCGTCCGTCCGACCTGAGCCGTCGCAGGGAAGGCGAGGCCGAGCAGTTGATCGGTCGATG
                                                                                    > M

25553  CCGCACGGGCCGTGCGCCGAAATGTGGAGATTGCGCAGTGCGTACACCGGATCTGTTCATCGGCGCCGTCGGCGCCTTCGTCCCGCCGAC
       > P H G P V R R N R G D C A V R T P D L F I G A V G A F V P P T

25645  GGTGAGCGTCGAGTGGGCCGATCGACCGGGTCTTTACTCCCGGAGCAGGTGGAGCTGCACGAGCTGGCGGGCACGGCCATCGCCGGCGACC
       > V S V E W A I D R G L Y S R E Q V E L H E L A G T A I A G D

25737  TGCCCGCGCCGGAGATGGCGCTGCGCGCCGCCCAACAGGCGGTCAAGCGCTGGGGCTCGCCGACGGAGTTCGACCTGCTGCTCTACGCC
       > L P A P E M A L R A A Q Q A V K R W G G S P T E F D L L L Y A

25829  AGCACCTGGCACCAGGGCCCGACGGGCTGGCCGCCGCACTCCTATCTCCAGCGGCACCTGGTCGGCGACCTGGCTGGCGTTGGAGATCCG
       > S T W H Q G P D G W P P H S Y L Q R H L V G D L L A L E I R

25921  GCAGGGCTGCAACGGGATGTTCAGCGCGTTCGAGCTGGACGTGTCGGATGGCGGGCCCCAGCGCCTCATCCTCACCAAG
       > Q G C N G M F S A F E L A A S H L Q A V P E R T S A L L V A

26013  CCGACAACTACGGCACCCCGATGGTCGACCGCTGGCGGATGGGCCCCGGCTTCATCGGCGGCGATGCCGGCAGCGCCCTCATCCTCACCAAG
       > A D N Y G T P M V D R W R M G P G F I G G D A G S A L I L T K

26105  CGACCCGGCTTCGCGCGCCTCCGCTCGGTCTGCACCAAGTCGGTCCCGGAGAGCGCCGAGCGCCTGCACCGGGGCGACGAGCCGCTGTTCCCCCC
       > R P G F A R L R S V C T K S V P E A E R L H R G D E P L F P P

26197  GAGGGTCCTGACCGGCCGGGAGCTGAACTTCACCGCCCGGATCGACCAACAGTTCGCCGCTCGATGCCATGGCGGACG
       > S V L T G R E L N F T A R I D Q Q F A A R S P A S I A M A D

26289  TCGGCGACCACATCGAGGAGGTCGTGGGGCGCCTGGCCGAGGCGGAGATCGAGGTCGGCGACCTCGCCCGGGTCGCCTTCATGAACTTT
       > V G D H I E E V V G R A L A E A E I E V G D L A R V A F M N F

26381  TCCCGGGAGATCATGGAGCAGCGCTGCCTGGCCAACTGGGGCCTGCCCATGAGCCGGTCCACCTTCGGTCGCCGATCGGGCACTG
       > S R E I M E Q R C L A N W G L P M S R S T F D F G R R I G H C

26473  CGGGGGCAGGAGCCCTTGCTGGCCCTGGAACACCTGGCCAGGACGGGGGCCTCGGCGTTGCTGACCCTGCTGACCACCCTGGCCACCGCGC
       > G A S D P L L A L E H L A R T G G L G P G D H L L L T L G T A
```

FIG.11A(23)

```
26565 CGGGCGTGGTGGTGTCGCGATCGTCCAGGTGATCGAGTCGCCGACGTGGCGGGAGTGACCCGTGGACACCTGCGGGCGGCCCGCCCA
      > P  G  V  V  V  S  C  A  I  V  Q  V  I  E  S  P  T  W  R  E  ·
26656 GCCCAGCAAACGACAGCAGGGGATGATTGTGGAAGCAGAGAAGGACCGGTTGCGTCCGGTTGGCGTTCCGAGGCGGTCGCCGTGGTGGGGA
        > V  E  A  E  K  D  R  L  R  P  V  A  S  E  A  V  A  V  V  G
26746 TCGGCTGCCGGTTCCCGGGCGACGTCAACTGCCCCGACGAGTTCTGGGACCTGCTCACCGGGGGTCGCAACACCACGGGGACGGTGCCCGAG
      > I  G  C  R  F  P  G  D  V  N  S  P  D  E  F  W  D  L  L  T  G  G  R  N  T  T  G  T  V  P  E
26838 GAGCGCTGGAGCGCGTACCGCGACCTGGGTCCGGCGTTCGAGTCCGCGCTCCGGTCGGCAGCCACGGCGGGCAACTTCCTGGCCGACATCTC
      > E  R  W  S  A  Y  R  D  L  G  P  A  F  E  S  A  L  R  S  A  T  R  A  G  N  F  L  A  D  I  S
26930 CGGCTTCGACGCGGACTTCTTCGGCATCTCCCCGCGCGAGGCCGAGCTGATGGACCCGCAGCAGCGGCTCATGCTGGAGGTGACCTGGCAGG
        > G  F  D  A  D  F  F  G  I  S  P  R  E  A  E  L  M  D  P  Q  Q  R  L  M  L  E  V  T  W  Q
27022 CGCTGGAGGACGCCGAGCCTGCCGGATCCGGGGTCATCGACGCCCTGGCCGTCTTGCACCTACGACTACGGCGGCCAC
      > A  L  E  D  A  G  I  P  P  R  T  L  A  G  T  D  V  G  V  F  A  G  V  C  T  Y  D  Y  G  G  H
27114 CAGTTGGAGGACCTGCCGCACATCGACGCTGGCATCGGCGCCGCAACCTGCGCGTCTCCCACGTGCTCGACCT
      > Q  L  E  D  L  P  H  I  D  A  W  T  G  I  G  A  A  T  C  A  V  A  N  R  V  S  H  V  L  D  L
27206 GCGCGGGCCGAGCCTTGTCGATCGACACCGCCTGCTCGGCGTCGATCACGCCCAGTCGGCCCGGTGCCCTGGCACCCGACGGGCGC
        > R  G  P  S  L  S  I  D  T  A  C  S  A  S  L  V  A  L  H  L  A  A  Q  S  L  R  L  G  E  S
27298 CGCTGGCGCTCGCCGGCGGGGTCAACCTGATCGTCACGCCGGGCCAGTCGATCACCCTCGGCTCGGCCGGTGCCCTGGCCCCGGACGGCCGC
      > T  L  A  L  A  G  G  V  N  L  I  V  T  P  G  Q  S  I  T  L  G  S  A  G  A  L  A  P  D  G  R
27390 AGCAAGTCCTTCGACGCCACGGCCGACGGCTACGGGTCGTGGGCGAGGGGTGCGGCGTCCAAGCTGCTCTCGTGCTCAAGCTGCTCTCCGACGCCAGGCGGGA
      > S  K  S  F  D  A  T  A  D  G  Y  G  R  G  E  G  C  G  V  L  V  L  K  L  L  S  D  A  Q  R  D
27482 CGGGAGACCCGGGTGCTGGCCCTGCGCGGCTCGGCCGTCAACCAGGACGGCCGCACCAACGGCATCATGGCACCGTGCGGCCAGGCCCAGG
        > G  D  R  V  L  A  V  L  R  G  S  A  V  N  Q  D  G  R  T  N  G  I  M  A  P  C  G  Q  A  Q
27574 AGCACGTGATGGTCCGCGCCCTGCGCTCGGCCGGCATCGAGGCCGGCAGCGTCGACTACATCGAGGCGCACGGCACCGGCACCCCGCTCGGT
      > E  H  V  M  V  R  A  L  R  S  A  G  I  E  A  G  S  V  D  Y  I  E  A  H  G  T  G  T  P  L  G
```

```
28770  GTGGTCTCCGGCGACCCGGCCGCGGCCTGGACGCGGCTGGTCGCCGAGTGGACCGAGGAGGGCCTGGGCGTACGCCGGGTCGCCTCCGACGTGGC
       > V  V  S  G  D  P  A  A  L  D  A  L  V  A  E  W  T  E  E  G  L  G  V  R  R  V  A  S  D  V  A

28862  CTTCCACAGCCCGCACATGGATCCGCTGCTCGACCGGCTGCGCGCCGCCGTCGACTTCACCGGCGTGCCGATCTACAGCA
       > F  H  S  P  H  M  D  P  L  L  D  R  L  R  A  A  V  D  F  T  A  R  A  P  R  V  P  I  Y  S

28954  CGGCGCTGGCCGATCCGCGGGCCCCGATCACCGCCGATGGCGAGTACTGGGCCGCAACCTGCGCAACCTCCGGCTGCAGCGGTG
       > T  A  L  A  D  P  R  A  P  I  T  A  D  G  E  Y  W  A  A  N  L  R  N  P  V  R  L  A  A  A  V

29046  GCCGCCGCCGTCTCCGACGGACACCGGGCCTTCATCGAGGTCTCCCCGCACCCGGTTGTGACCCACTGACCGATCACGAGACGCTGGCCGGAAG
       > A  A  A  V  S  D  G  H  R  A  F  I  E  V  S  P  H  P  V  V  T  H  S  I  H  E  T  L  A  G  S

29138  CCTCGACGACGAGGTCTTCGTCGGCGGCACCCTGCGCCGCGACACCCCGGAGGCGCAGGCCTTCCTGTCCAGCCTGGGGGCCGCACTGCC
       > L  D  D  E  V  F  V  G  G  T  L  R  R  D  T  P  E  A  Q  A  F  L  S  S  L  G  A  A  H  C

29230  ACGGGGTCGCGGTGGACTGGGGCCGCGTGCATCCGTCCGGGCCACGACCCCGCTGGTCACCCTGCTCGGCGCGGTCGACAACGTGGCGGGCAGCGACGT
       > H  G  V  A  V  D  W  G  R  V  H  P  S  G  P  L  V  T  L  P  G  Y  P  W  R  H  R  S  H  W  H

29322  TGGCCGACGCCGGCCGCCGGCCACCGACGGCGCCAGCCGCCCGTACCCGGGCAGCCACGCCCTCAACGGCGTGGAGATCGTTCCGGCGGCCGTGC
       > W  P  T  P  A  A  A  T  G  R  G  H  D  P  A  S  H  T  L  L  G  A  V  D  N  V  A  G  S  D  V

29414  GCGGGTGTGGCCGCACCGACTCGACGACGCCAGGCCCTCATGGCCTGCGCGCGGCGGGCGGACGGCCGGGCGGGCGGACGACCCGCTGATGCCGTACCGCTGATGACGCCGGG
       > R  V  W  R  T  A  L  D  D  A  S  R  P  Y  P  G  S  H  A  L  N  G  V  E  I  V  P  A  A  V

29506  TGGTGGAGACCCTCATGGCTGCCGCCGCAGGTGCCGGCGACGTGCCGAGGTGCGCCGTCCGTTCCGTTCCGTTCCGAGCCGGGACTGGCT
       > L  V  E  T  L  M  A  A  A  G  R  G  D  G  R  P  L  L  T  G  L  S  M  R  Y  P  L  M  T  A  G

29598  CTGCACGACGAGGTCCAGGTGCGTGCGGGACGCGGAGGTGCGCGACGGTGCCGAGGTGCGCGCGGTGCTCGCCGCGCGGTCGGTGGACGCCGAGGCCGACCCGAGCCGGGACTGGCT
       > L  H  E  V  Q  V  V  R  D  G  A  E  V  R  L  A  S  R  S  V  D  A  E  A  D  P  S  R  D  W  L

29690  GATCCACACCGACGCCACGGTGGCCGACGCGACCGTGCTGGCCGCGCGCGCGCTCGCCGACCCGGACGACCACCGGATGGAACCGG
       > I  H  T  D  A  T  V  A  D  A  D  A  T  V  L  A  A  R  A  L  A  D  P  D  D  H  R  M  E  P

29782  GCGACCCGGGCTCCATCCACCGCCGGCTGGCCGAGGTCGGGGTGCCGTCGACGGGATTCGACTGGTCGGTGGAGGAGCTGCTCTCCGGGTAC
       > G  D  P  G  S  I  H  R  R  L  A  E  V  G  V  P  S  T  G  F  D  W  S  V  E  E  L  L  S  G  Y
```

```
30976 CGAGCACGGACAGCACCACCGTGCCGCAGCGGTGCCAGCGGTGCCGGGGAAGGCCGATCAGGACACCCGCCACCAGCGCG
      < L   V  S   L  V  V  T  R   L  P  A  L  R  A   P  E  G  N   G  P  L  G   I  L  V  G   A  V  L  A
31068 CCGAAGATCGCCTCCAGGCCCGTGCCGCGTCGCGCAGGGCCGACGGCGCTGGCGGCCCCGCCGTCGGG
      <G  F   I  A  E  L   G  L  A  H   A  G  A  A   F  A  L  V   I  V  V  A   V  A  S  A   A  G  G  D   P
31160 CTGGGCGTTGCGCCAGCGCATGGCGCGCGGGTCACCGGCGTCACCGACCAGGAGCCGGCCACCGCGAGGTAGGCCACGAGGTAAAGCAGGGCGG
      <Q  A   N  A  W  R   M  A  R   R  T  V  P   R  G  V  L   V  A  V  A   L  Y  A  V   L  Y  L  L   A  T
31252 TCACCACCTGCCGGCGGTGAGGGTGCTCACCGCCACCGACGAGATGAGCGAGCAGGAACCAGGCCGAGCCGCAGCGTCTCCAGCGACGCCGCA
      < V   V  Q   G  A  T   L  T   S  V  A  V   S  S  I   L  S  L  L   F  W  A   A  A  D  E   L  S  A   A
31344 GCCAGGATGATCTGCCCCACGTGCAGCAGGCCATGCGGGTCTTCGGATCACCGGCGTCTTCGAGCGTCTTCGAGCGCTGACCGCCATCGCCAC
      <A  L   I  I   Q  G   V  D   R  H  L  L   R  M  D   T  L  T  T   K  A  I   V  P  V  A   S  V  A  M   A  V
31436 GCCGACGAACAGCGCGAAGACAGTCCGCTCCTCGCCCGCGAGAAGCGCCAGCGCCGGCCAGCGCGGCGATGCCAGGCCGGGCCACGGCGACC
      <G  V   F  L  A  F   V  T   R  E  Q  G   A  A  L   L  A  A  P   A  L  L  G   A  A  I   G  L  G  L   P
31528 GCACCGCGAGGCGTCCGACGGCCACCGACATCGTGCCGCCGAGGCTGCGCCGGACCAGCGCAGCGCCGGTCAGGTGCAGACCGGCCACGGCGACC
      < V   A  L  G   G  V   A  V  A   G  I  T  G   A  R  R   R  V  L  R   L  D  L  H   L  G  A  V   A  V
31620 AGCAGTACGACGCCGAACTGACCGATGGCGTCGAGCAGGTGGACCTGGTCGGGGGTCGGCGCCACCGTCCGATGTCGGGTGCCAG
      <L  L   V  V  G   F  Q   G  I  A   D  L  L   H  V  Q   D  P  D  A   P  L  L  W   R  G  I  D   P  A  L
31712 GGCCCCCAGACCGAGGGCGTGCAGCTCAGCAGCAGTCTCCTGGAGGTGTTGCGCCAGGCGAAGCGTTGCGCCAGGATGCGTTGCCCAGGA
      <A  G   L  V  S   P  G   L  L  V   G  T  L  L   E  G  V   V  A  P  L   G  F  R   Q  A  V  R   G  L  V
31804 CGACGGCGAGCAGCAGCAGCAGCCCACCTGGAGCAGGAGAACAGTAGCTGGTGGGAGCCAGCGGGGCACCGGCGGGCCACGATCA
      < V   A  L  L  L  L   L  G  V   Q  L  L  F   L  L  L   Q  H  S  G   L  P  P  V
31894 CGGTCGTTGTTCCTTTGTCTCGACGCCCGGCCCCGGGTGCCCGGTGTCAGGCCGCGATCTCGGCGCCGGCAGGTCCACGGGTCGGCGAGT
                                                                  < ·  A  A  I  E  P  P   L  D  V  P   D  A  S  N
31985 TCATGAAGGTCCGCAGGGCCGCAGTCGGCGGCAGTGGCGCGGGGCTTCTCCCAGCGCCAATCGATGAGGGGAGGTCAGTCTCCCGGTG
      <  M  F   T  R   L  A  R   L  D  A   A  P  K  E   W  G  L  G   A  C  W  D   I  L  S  T   L  E  G  T
```

FIG. 11A(28)

```
32077  GCCCGAACCTTGTCCTCCTCGGGCAGGCTGAGCACGACATCTCGGCCGGCCAGGTTGCCAGGTTCCACGTGAGCCCCTCGGC
       <A R V K D E E P L S L V S M E  A P W Q V V N A L D V D L G E A
32169  CCGGGCGAACTCCAGCAGGTCGCGCAGCCCCAGACGTTGTCCGCTGGAGCCAGAGGTTGACCTCCAGGGGCCGGC
       <R  A F E L L D R L G W V N D R Q P A V Q L W L N V E S R A R R
32261  GGACGTTCGCGATGAAGGTCTCCCACTTCGGCCCTCGCGATCCGCTCGAACACCTCGGCCGTTGCAGGAGGCGCCATGCCGATG
       <V  N A I F T E W K A G Q R I R E F V E G Y G D C S A G I G I
32353  CTCTTGAAGTGCCGGAACCGGTCGAAGACCGATCCGGCAACACTCCGGCAACCTCCGGCAACCTGAGGTTGTAGACGACGTTGACGTTGCCGGTTACCCGT
       <S  K F H R F R D F V S E P L V T L N S N Y Y V V D V N G A N G T
32445  CTCCACCAGCAGGTCGAGCAGGGCGAAGTGGCCGGCTGTCATGAACGGCCTCCCCACCGGGCGAAGTACAGCCGCCGGATGAGGTGGGCGTTCT
       <E  V L L D L L A F H G P Q M F P E G G A F Y L R R I L H A N E
32537  CGGCGCAGGGCTGCCACGCTCGTCGTCCCGGCTAGGACCGGCGACGACCAGGCGGCCCCGCTTCTTGGGCGCCCCAGCGAG
       <R  L T Q W L E D D D R Y A D I V A S S W A P R K K A G W G S
32629  CTGACCGGGCTACGCGGGCCACATCACGCACCGCAGGCTGTTGCCGAACGGATGTGCGAGGAAGAACGGAAGTCCTCGACGGTGCCGTC
       <S  V P Y A C M V C R L N C T N G F R I D L F F P F D E V T G D
32721  GGGCGCGGTGCCGGGCGGCCAGCCCGTCGGGGTGTTGATCTCCTGCCGGTACGACAGGCGCCGTGGTCCT
       <P  A T R A A L R D P D A I D R F R Q N I E Q R Y S L A G H D E
32813  CGCGGTGGTAGCAGTAGGAGCAGGCGGTCGACCCGCTCCCCGGCCATGCGCCGGTCCGGCGCATGTTGGGCGTGTTGAAGGCGTC
       <R  H Y C Y S C A D V R E G A L M A L R T R R M
32904  CGCCAGGCCCATCACCGGCGGGGTTGTCCGCGGTAGCGGCGAGCAGCCGAGCGGCGTCGTCGTTGAGCAGGAACTCCGGCT
       <P  R H Y C Y S C A D V R E G A L M A L R T R R M *
32996  CCTCCTCCTGCTCAGTCTTGTTGTGATACATCGAGTCGTCCACGAGCAGTCGTCGATGACGGCAGAGATGGATC
33088  CAGGGCAGCAGCACGCACATGGTGGTTCCGGGACCGGGTCAGTCATGAAAGTTGATCACCTCGGTGGTGGGCGGTGTCATCCCGGTCG
                                                                                                    <•  G P R
33179  GCCGACCGTCTCGACCGGGACGGGCAGCGGGAAAGATCAACCGGGTGCCGCTGGCAGCATCTCCGGCGACATCTCGTCCCGGAAGT
       <G  V T E • V R P L P F F I L R T G S S A L M E A E R R A V I E D R F H
```

FIG.11A(29)

```
33271 GCCAGGGCAGGACCAGTAGTCCGGGGGGCCGCCCCGCGACTCCTGCTGCTGATGATTTCGATGTCCGTGCCGAGGGTGCGCGCCC
         W  P  L  V  L  Y  Y  D  P  R  A  A  R  S  E  Q  E  S  I  I  E  I  D  T  G  L  T  R  A  G
33363 ACCTTGTCCGGATTGCGCTCCGCGGCGTACCGGATGAGCTCCGGGTCTATGCGCAGAACTGCAGGAGGGTGTTGCCCTTCGTCGACGCGCC
         V  K  D  P  N  R  E  A  A  Y  R  I  L  E  R  D  I  G  C  F  Q  L  L  T  N  G  K  T  S  A  G
33455 GTAGACGTGCACGTGGGCGCCCTGGCCTCGCGCCAGCTCCGGCGACAGGGCGCTCACCTCGTCACGCTGCTGGCGCACTGCTCGGCGAAGCGCT
         V  Y  V  H  V  T  R  G  Q  G  R  L  E  R  L  L  A  S  V  E  D  R  H  Q  R  V  Q  E  A  F  R  Q
33547 GGTACGGGGGCGTCGCCGTCCAGCCCAGACCCAGCTCCCGGTCGGGAGTGCCTTGACCGAACCGTCGGCCGAACCGCCCGGCGCCCACCTCACCGGCC
         V  Y  P  A  D  G  D  L  G  L  A  L  E  R  D  A  L  A  K  V  S  G  D  A  R  G  G  V  E  G  A
33639 CGGGTGACCACGCAGCAGATCGAGCCGCGTTCACCCCGTTGAGGCTGGCACGGACGATCTCCAGGCCCGCCGCCGCCCAGAATGCGGCTCAG
         R  T  V  C  C  I  S  G  N  V  G  N  L  S  A  R  V  I  E  L  G  A  A  G  L  I  R  S  L
33731 CGTGGCCAGGCGGAGTAGTAGGACAGGTGCTCGTGGCAGATGCTGTCGTAGCCGGATCTCCAGCATGCGCGGCAGGTAGGCGACCTGACCA
         T  A  L  S  Y  Y  S  L  H  E  H  C  I  S  D  Y  G  A  I  E  L  M  A  P  L  Y  A  V  E  V  V
33823 CCCAGACCCCGCCCGGGGAGCAGCGCCTGGGCGGGGACCAGCTCGGGAGAAGAGTCGGCGGTCGTCGATCGAGGTGACC
         W  G  G  P  A  L  L  A  E  V  Q  R  A  F  E  V  P  D  E  V  D  Y  F  M  A  I  S  T  V
33915 AGGTCGAAGCTGCCCGGGCAGCTGCCCGGTCAGGTTGCCGCTGCGCTGCTGCAGGTGTCGAGCACCTTGCCGGGCCGCT
         L  D  F  S  G  A  H  P  V  L  E  P  S  P  F  F  D  R  I  L  N  F  D  D  P  A  D  D  A  A  S
34007 GGAGGGGGTCGATGCCAGACCGCGCTGCCGCCGTCGTCAGGGTGAGATGCCGAGATGTCGAGCACCTTGCCGGGCCGCT
         S  P  D  I  G  W  R  Q  A  D  T  L  N  G  L  L  T  G  D  N  C  G  I  D  L  V  K  G  P  R  E
34099 CCCCCAACACCTGCGACCGCCGGTCACCGCGGTGACGCATCGTGTCGTTGATCCGGAGGGTACCAGTAGGTGTCGTAG
         G  L  V  E  V  A  A  D  V  V  D  A  L  H  R  R  M  T  D  N  I  R  S  R  Y  W  Y  T  D  Y
34191 AGCAGCCCACCGGCCAGGGTGTGCCGCAACTGCCGGTTCACCAGGGTGCCTTCAGCTCCAGGGGGAA
         L  L  G  G  P  L  T  H  R  L  Q  V  L  G  C  P  D  G  G  D  R  E  A  C  R  T  L  E  L  P  F
34283 GCGCACCCCTGGGCGGGGTTCCGACACGGCTTCACGAAGCTGCCCTGTAGGTACTGGGCACCGAGGTCGAGGACCGTACGCAGGGTCCCGC
         R  V  R  P  P  D  S  V  G  P  K  V  F  S  G  Q  L  Y  Q  A  G  L  D  L  V  T  R  L  T  G  G

FIG.11A(30)
```

```
34375 CACACACCCGGCAGGTGGTCCGCTCGACCACCTCCGACGCCACCTCCGCCGGCCGCCGCCAACTGGCTCACGTCAGGTCCTCCTCGT
      < C   V   R   C   T   T   R   E   V   V                                   <·  T   R   R   T
34464 CTCGTGCCGGTGTGCCGGAGACCAGGCGCCCCGTCGTGCGGTTTGCTGGCGACCAGAGGATGTCCAGATAGAAGGGCTGGTCGGGGCCCTCGC
      <E   H   R   H   A   P   G   P   A   G   D   H   P   K   S   A   V   L   L   I   D   L   Y   F   P   Q   D   P   G   E   S
34556 TGCGGCCGAGATGCCGGAACGCCCGGTCGAGGTACTCGTCGAGCGCGCGGGCCGCGCCAGCAGCACAGGGCGCCAGGGCCAGA
      < R   G   L   H   R   G   A   R   D   L   Y   E   D   L   A   R   P   R   L   R   D   V   L   W   L   A   R   L   A   L
34648 CCCACCCGGCCGCCGACGGCCAGCCGTCGCTGCGCGGCCGTACCAGCAGCGCAGCAACAGGCCGCGGCCCAGGTCAGCTTGACGGT
      <G   V   P   G   G   S   P   W   G   H   E   R   G   Y   W   E   L   L   L   L   G   R   P   G   C   T   L   K   V   T
34740 GCGGTCGACGGTGAAGCCGGCCACTCGGCCTGGGGCCACCGGCCAGCCCGTCGGCGGTCCACAGGTCCTGGCCGCGTGCTCCTCCCACA
      <R   D   V   T   F   G   A   W   E   A   Q   R   A   L   G   D   A   T   W   R   W   L   D   Q   G   H   E   E   W   V
34832 GCCGTCGGGTGGAGAGCACCAGCGGCCGCGCCGGGCGCGCCTCCCCAGGTACGCGTCCGAGACGTGTTCGAGC
      < G   H   T   S   L   V   L   R   G   G   P   R   L   L   R   Y   A   E   R   L   Y   A   D   A   D   S   V   H   E   L
34924 ACCTGGGTCGGAGACACCCGTCGAACGTCCCGGCAGGGCGTGGTCGCGCAGGGACTCACC
      <V   Q   T   S   L   V   G   D   F   T   G   D   P   V   P   C   R   G   D   R   D   L   A   H   D   A   P   L   S   E   G
35016 GCCCGGGATGTCGGGCTCTGCAACTCGGCGCGCCAGGTCGCGCGCAGGCGCCGTAGTGCGGCCGTGGAGCCAGACTCCCGTGG
      <G   P   I   D   A   T   Q   L   E   A   S   R   F   L   G   R   Y   P   S   T   G   A   G   Y   D   L   W   V   G   T   A
35108 CGTCCCGGACCGCCTCCGCCAGCGCGTCGCGCAGGTCAGGAAGTGGGCGTATGCCGGGGCTCGATCCGCTCCCGGAAC
      < D   R   V   A   E   A   L   A   D   R   L   D   L   F   H   A   Y   A   W   D   G   P   R   P   E   I   R   E   R   F
35200 CGTTCGGCCATCACCTCGTCCAGGACGGGACCGGTCGGGGGACGGGACCAAGCCGGGTACGCCGGGGCCAGC
      <R   E   A   M
35290 AGGGTCACCAACGCCAGTACTCCTGCCGGTACGGCATGGTGGTCGGCTCCGGCAGGCCCTCCCAGCGCCGGCAGCGACGCGGGCCG
      <·  W   R   W   Y   E   E   H   P   Y   R   M   T   T   P   E   P   L   G   E   W   R   R   L   S   A   A   P   R
35381 GTACTCGAAGGGCTGCTCGCCGGCCGTGCTCCGGTGCCGCCGTGCCAGCAGGAGCAGCACCTGCTTGAGCCTGATGTACT
      <Y   E   F   P   Q   E   G   A   H   E   P   A   A   R   R   Q   A   L   C   S   L   L   V   Q   Q   K   L   G   I   Y   E
```

FIG.11A(31)

```
35473 CCGGCACGTGCGGGCCGAGGTCCAGCTCGACCTCGGCGGGCCGGTACTCGAAGTAGATGACCCGGCCGCTTGCCGGTCACCGCCGGCGCG
       < P  V  H  P  G  L  D  L  E  V  E  A  P  R  Y  E  G  Y  I  V  R  R  R  K  G  T  V  A  P  A
35565 GCGTGCAGCATCAGGATGTTGTGCAGGATCACGTCGCCCGGGTTCATCACCGCCGGTTCCCACTCGGTGTCCGGGCGTTCAT
       <A H  L  M  L  I  N  H  H  L  M  V  D  G  P  N  M  V  A  P  V  A  G  T  T  D  W  E  T  A  N  M
35657 CCGGGTGGTGTCGTCGTTCGCCCGGTCGGTGTCCAGTAGTTCGACTGCGGGATGCACAGAGCGCAGTGTCCTCCGGGGCCGGGTCAAGGT
       <R T  T  T  E  N  A  R  D  T  D  W  Y  N  S  Q  P  I  C  W  V  C  N  D  E  P  A  P  D  L  Y
35749 AGATGCCGACGTCGATCACCCGGCCCGCGGTGATGCCGACCCGTTCTCCGGGTAGAGGCCGCGTCGCGGTGCCAGGGCAGCCGGGGC
       < I  G  V  D  I  V  R  G  A  G  T  I  G  V  A  N  E  P  Y  L  G  G  D  R  H  W  P  L  R  P
35841 GCCCCGCCTCGGTCTTGAAGACCATGCTGTCCAGGTGGGATGGATGAGGTTGGGGCCGAGCCAGGTCCTCCATCGCCGCCAGCAGGGGTG
       <A G  A  E  T  K  F  V  M  S  D  W  T  P  I  L  N  P  G  V  L  D  E  M  A  R  L  L  L  P  H
35933 GCCGGAGGACTGCGAGCGGGGACTTGTCGACCACGTACTGTGACCACGTGCCGCCTCGTGCGGTTCAGCGTCCAGA
       <A G  A  E  T  K  F  V  M  S  D  W  T  P  I  L  N  P  G  V  L  D  E  M  A  R  L  L  L  P  H
36025 TGGTGTCGGTCATGTCCGGGTGCGCCAGGCTTCGTGCATCAGTCGATCAGCTCGTCGGGGTCGTCAGCAGC
       <T D  T  M  T  R  T  R  W  A  E  D  I  L  E  D  A  A  A  Q  V  S  R  L  E  D  P  D  L  L
36117 CCGCGCAGGATCAGCGCGCCCTGCCCGGCGAAGGCGGTCAGGTGCTCCGGAAGCAGCCCGGTCTCGTGGATGTGGCACTCGGGGACGGCCTG
       <G R  L  I  L  A  G  Q  R  R  F  A  T  L  H  E  P  L  L  G  T  E  H  I  H  C  E  P  V  A  Q
36209 CTCGGTGCGGACGTCCACAGTCGGCGTCCATGGTTCGGTCTCATGGTTCGTGCTGCCGGAGCGCCGGCGGGCCCG
       <E T  R  V  D  V  T  A  S  M    .  P  E  T  G  K  Q  W  A  S  P  E  H  Q  G  S  S  G  G  A  P  G  P
36300 GGCTCGGTCGGTCGGCGACGAAGTACCAGTGCTCCCGCAGCGCGTCGGCGAACCCGGCCAGCGCCCGGAACGCCAGCGCCCG
       <S P  R  D  A  V  F  Y  W  H  E  R  L  A  D  A  F  G  A  R  D  L  A  P  Q  G  A  R  R  G
36392 GGCAGGGTACGCAGGATCGTAACCCAGCTCGGTCACGAGCAGCGGCCACAGAGCAGCCTGGTGGTGCCGTACTCCGCATGGCGTGGTCGCC
       <P L  T  R  L  E  Y  G  L  E  T  V  L  L  A  W  L  D  A  S  T  T  G  Y  E  R  M  A  H  D  G
36484 GCCGTGCTCGAAGACGATCACCGGCCGTCCAGCGACCGCGAGCAGCTCCACGCGACCACCTCGCCGCACCTGCCCTCGGTGTCCACCT
       <G H  E  F  V  I  V  P  R  W  R  R  L  L  E  V  A  G  R  L  A  L  V  E  G  G  E  T  D  V  K
```

FIG.11A(32)

```
36576 TGACCAGGTCGATCCGGCGGTCACCGGGGAGCACGTCTGTCCAGGCGGACGGTGTGTGACCGTCAGTCCCGCCAGGGTCTCGTCGGCGGTCG
      < V  L  D  I  R  R  D  G  P  L  V  D  D  L  R  V  T  D  V  T  L  E  R  L  T  E  D  P  R  D
36668 TAGGGACGCCGGCGCAGCCCGCTGTAGCCGGGGGTGGAGACCACGTTGGACGAAGTCGTCCCGGCTGCGCTCGGCGGTGCCGGCCGGCCAC
      < Y  P  R  R  R  L  G  S  Y  G  P  N  S  V  V  H  V  F  S  D  R  G  T  R  E  A  A  A  A  V
36760 CACCGGTCACGCGGGGGAAGTCCCGGCAGCCCCTCGCGTACGACGGCCCGATGTGTCACGGTGTTGGCGTCCGGTTCGCAGATCGTCGATCAGCGC
      < V  T  V  G  P  F  D  R  R  L  G  E  A  Y  S  P  L  A  E  V  A  V  H  R  G  R  P  A  V  R  L
36852 GCAGGTGACGCAGGATGTCGCCGGCGCGGCCCCGATGTGTCACGGTGTTCACGGTGTTGGCGTCCGGTTCGCAGATCGTCGATCAGCGTGAGC
      < L  H  R  L  I  D  G  A  G  A  G  I  D  V  T  N  A  D  P  E  C  I  Q  E  I  L  A  V  T  L
36944 TGGTCGTACCAGTCGTTCATCGACAGCTCGTTGCGGTCGCCGAAAAGCTCAGTGGACATCGTCAGTGGACATCGTCAGTCCTCGGTCCGGCACGCC
      < -  H  V  D  D  R  E  E  T  R  C  A
      < Q  D  Y  W  D  N  M
37035 GGTCCGGCCCGGAGCGACCGGCGGTACGCGGGGCGGTACGAGGAGTTCCAGCTCCCGCAGCTCGATCTCGGACAGCTCCAGGCCGGCGGCGCG
      < P  G  A  G  S  G  V  A  P  A  T  R  V  L  L  E  L  E  R  L  E  I  E  S  L  E  L  G  A  A  R
37127 GACGTTCTCCTCGACGACTTCCCGGGGCCCACTGAGCGCCGCACCACCCCGGCCGGGTGGTGCAGGCCAGTGCAGTGCCACCTGCG
      < V  N  E  E  V  V  G  P  S  Q  A  G  F  V  P  V  V  G  A  P  H  H  L  A  W  A  L  A  V  Q  A
37219 CGACCGGTGTGCCCACGTCGGCGGCGAAGGCGGCGAGGCCGTCGACCACGTCAGTCCTCACCCGGAAGGCGTGCGAG
      < V  T  H  G  R  E  A  A  F  A  A  L  G  D  V  V  D  L  L  Q  A  Y  D  E  G  R  F  A  H  S
37311 TAGGGCCCGCCAGTCCTCGGGGGCAGCGGAATGCCGGTCGCGGTGCAGCCCGTGGGCGAGGCGCGGAGCCGCCAGCACCCC
      < Y  A  R  W  D  E  P  A  F  A  Q  D  R  H  L  A  G  T  L  L  G  H  A  L  A  S  G  G  L  V  G
37403 GACGCCGGCCTCCTGGCCCTCGCAGCGGGCCACCTTCTCGGCCACCAGGTTGAACGGCCACCTGGACGCAGTCGTCCAGCAGCCCGG
      < V  G  A  E  Q  C  R  P  L  V  E  K  E  A  G  R  D  L  L  N  F  P  V  Q  V  V  D  L  L  G  T
37495 TGGGCACCAGCTCGGCCAGGTCGCCGTCAGTTGGCAGGCCGACATGCCGGCGGCCAGGCCCTCGCGCCACGAACCCGGCCAGCACTCG
      < P  V  L  E  A  L  D  G  A  T  V  N  A  F  G  V  H  R  A  L  G  E  R  V  F  G  A  L  V  E
37587 GCGGTCTCCGGAGCGGGGACGTCGGGGTCGGGAGTACACGTGCCAGTCCGGTCCGTGCCGAGCTCGACGCAGGCTGGCCAGCAG
      < A  T  E  A  L  P  V  T  P  D  D  P  W  H  V  S  Y  V  D  V  H  D  T  G  L  Q  R  L  S  A  L  L
```

FIG.11A(33)

```
37679 CTCGTCCCGGAGGAAACGCGGGGTCGCTGTTACGCACCGTCCGTCCCGGGGTCGAGCTTGTGCCGTCGCACGCCGGGCGGGTCTCCAGCC
      <. E  D  R  L  F  A  P  D  S  N  R  V  T  R  G  P  P  D  L  K  H  R  R  V  G  P  R  T  E  L  G
37771 CGCCGGCCGTGGCGATCACGATCTGTCCCGTGGCGGGCAACAGGTCGGCAAGGGCCGCTCGGCGGCCGGCCCCGGCCCG
      <. G  A  T  A  I  V  I  E  D  R  H  A  P  L  L  D  A  L  G  R  A  L  A  A  E  A  A  G  G  G
37863 TACGCCCCGGAGGTGTCGAAAAGGGTGACGCCCAGGTCGAAGGCCCGGCGGACGGCCTGCACGCTGGTTCGATCCGCCGGCCCACTGGCC
      <. Y  A  R  S  T  D  F  L  T  V  G  L  D  F  A  R  R  V  A  Q  A  G  P  E  I  R  R  G  W  Q  G
37955 GCCGAGCGCGCCCAGGTGCCCAGGACGCCGAGCAGCGGCCCCGCTCACCGATGCAGGGCTGCCGCACGGCGTCCTCCCGCCGGTG
      <. Y  A  R  S  T  D  F  L  T  V  G  L  D  F  A  R  R  V  A  Q  A  G  P  E  I  R  R  G  W  Q  G
38046 CCCCACCCACGCCCGTCGGCCGGCCGCCGTCACCGCGCTCACCCGCCTCCCCGTCGCGCCAGCGTCAGGAACACCACGCGTCGTGATTGATCATCT
      <.    A  A  P  E  G  D  S  R  L  T  L  F  V  V  G  D  H  N  I  M  K
38137 TGTCGGTGACGGCGTCAGCCCGGCCTCAGCCCGGCGATGCCGGTCATCAACTCCACGCCGTGCCAGTTCAGGAACTCCACGGGG
      <. D  T  V  P  T  L  G  A  E  A  A  I  G  T  M  L  E  V  G  H  W  N  L  F  G  K  F  E  V  P
38229 TTCGGTCGCGCTCGGGTACCGCTCGGGTAGGTGTGGAAGAAGCCGGTGTTGTCGGCAGGTCGGCGGAGGTTGAAGCAGAACAGCCCGCCGGG
      <. N  A  D  R  Y  R  E  A  Y  T  H  F  F  G  R  T  N  D  G  L  D  L  F  N  F  C  F  L  G  G  P
38321 CCGCAGGATCCGCGGTACCGGCCGGATCTGCAGGAAGTGCTTCTCGATGTGGTAGGAGACGTTCTCCCGGCCCTCAGGTGGCGCGCCTTGTCGAGG
      <. R  L  I  R  R  I  Q  R  F  Y  L  F  V  E  F  V  N  L  H  I  F  V  N  L  S  F  G  A  D  F  A
38413 CGGCGGTCGTCGACGCTGGCGGCAGAGCACGGCGGACACGGCCCTCGCCGTCCCTCGCCGTGATGCCCTCGGCCGATCTCGAAGAT
      <. A  T  P  L  K  E  L  F  D  N  E  I  H  H  Y  S  V  N  E  R  G  E  C  T  A  R  K  D  L
38505 AAGGATCGGCTGACGCTGGGCGCAGAGCACGGCGGACACGGCGACCTTGTCGACACGGTCCTGGAGTACTCCTCGCGGCTGGTAGCCGG
      <. F  S  R  S  V  D  A  C  L  V  A  R  V  R  D  A  L  G  A  A  M
38597 CTCCGAGTTCCGGCCGATTCCGGAGCCCGAGCTGCTCGACGACCAGGAGTGCTGACTGCTCGGACACGGCTGCGGAGGCTACTCCTCGCGGCTGGTAGCCGG
38689 CGAGCTGCATCTGCATCTCCTCCGGCGTGTTCCACTCCGAGCTCAGCTAGTTGAGGTCGCCGGTCTCCGAGCGGACAGCAGCCCGGGCGGGGGTCC
38781 TGCGGCCGGCGGCGCGTTCGCGTTCGCGTTCCTGCTTGTCGTTCATCGGAACGTCGGCGACGTCCTCGGGGCTCAGCGCTGTCGGGCACTGGGCTGCGG
38873 GAAAACTGGGCGGCGGGCGGGTGTCACGACGCGGGCGAACTCGGCGACGTCGGGCAGCCCGGTGTCGGCAGCGCCCGGGCCAGGAG
      <.    P  R  R  A  F  E  A  V  D  E  P  S  L  A  G  T  D  A  L  R  A  L  L
```

FIG.11A(34)

```
38964 TTCGGCCACCTGGACGCGGTCGGCCTGCCCGGTGGTGGTGACGGACTCCCGCATCCGTGCGCGCCACCCGGAATCGGTGGTCGTAGAGGACGGAGC
      < E  A  V  Q  V  A  T  P  G  T  T  V  S  E  R  M  R  Q  A  A  V  R  F  R  H  D  Y  L  V  S  G
39056 CGAGGGCCTCGTGCAGACCTCGACCTCTCGCGGGACGCCTTCAGGCCGGGCAGCGTCTTCGTCGCGGGTCGAGCCGCCCGTAGATCAGG
      < L  A  E  D  V  E  E  R  S  A  K  L  G  P  L  T  K  T  A  G  Q  P  D  L  R  R  G  Y  I  L
39148 GCGTCGTAGTTGAGCGCCAGCGACAACTGCGGCACGCCCATGGCGGAGAACTGGTTCATGTAGCAGTTGGGCTGCGCCTGGTCACCAGCAAGTC
      < A  D  Y  N  L  A  L  S  L  Q  P  V  G  M  A  L  G  N  M  Y  C  N  A  S  G  H  H  V  L  L  D
39240 GCAGTCGGGGAGGATGAGCTCCAGCGGGCAGTTGCTGAGCACGTTCGGGCGCCAGCCCTCCACTTCCAGGAGGCGG
      < C  D  P  L  I  L  E  L  P  C  N  S  L  V  R  V  N  P  P  L  A  G  L  E  V  E  S  S  A  A
39332 CGGTGATCACGACCTTCACGCCCCGCTGGGCGGCGACGGTCGAGGACCGAGCAGGGGGTCTCACGTCTCTGGAGCCGTTGTAGGGCTGGTAGGCGGAT
      < T  I  V  V  E  V  G  R  Q  A  A  A  D  V  A  H  R  L  A  P  V  Q  A  G  F  V  G  T  A  S
39424 TTGCCCCACACCACGCAGACCCGCTTGCCCCGCTTCCGCCGCGGTCTTCACGTCCTCGGGCGTTGTAGGGCTGGTAGGCGGAT
      < N  G  W  V  V  C  V  R  K  G  R  R  P  G  L  L  W  P  D  V  D  Q  S  G  N  Y  P  Q  Y  R  I
39516 CGGGATCCGGCGGTCGCCATCGGCGGGATCGCCACGTCGGGCGACGGGTACGGATGTGCGGCTCTCCACTCGACGC
      < P  I  R  L  A  D  G  M  P  P  I  A  V  D  P  S  P  D  I  A  Y  R  I  Q  H  R  S  W  E  V  G
39608 CGTACTTGCGGAACTCGTCGTTGCCGGAACCAGGTCGCCGGAGACCAGGTGGACCTCGGTCTCGATGGTGCCGATGAACCGGGCGAGAAGTAG
      < Y  K  R  F  E  T  V  P  D  G  S  V  L  D  L  G  P  E  T  E  I  T  G  I  F  G  P  S  F  Y
39700 ACGCTGGGGATGTGCAGCTGGTGCTTGTCGTAGCTGCGCTGGACCGCGGTGACGGTGCGCTTCCAGTAGTCGGCGAGTCGGCGAGCGAGT
      < V  S  P  I  H  H  L  E  A  V  L  A  G  E  V  A  M  I  D  H  V  V  L  D  P  R  Y  H  A  A  Y
39792 GTCGACCGCGTTGTCGTAGCTGCGCTGGACCGCGGTGACGGTGCGCTTCCAGTAGTCGGCGAGTCGGCGAGCGAGT
      < D  V  A  N  D  Y  S  R  Q  V  A  T  V  T  R  K  W  Y  D  A  L  L  D  T  D  F  D  A  L  S  D
39884 CCATCGGCCCGTGAAGGGGTTCAACGGCCAGCGGTTGCTCCACCATGTCTGCGGGGTGTAGAGGGCCTGAGACGTAGAAGCCAGCCGG
      < M  P  R  G  T  F  P  N  L  P  L  P  Q  E  V  M  H  Q  P  T  Y  L  A  Q  V  Y  F  G  L  R
39976 GCGCTCTCCATCATGTCGGGGCCGTCGAGACGGATCATGCCCGCCGGCCGGACCTGGACGGCGAACAGGCGAC
      < A  S  E  M  M  D  P  G  D  L  V  S  V  P  M  M  G  A  A  V  G  R  V  Q  S  P  S  C  A  V
```

```
40068 CTTGACGTCGTGGCCGGCCGCCCGAGCGGCCCAGGCCAGCGGCGGCACCATGTCACATGTAGTGCCGGCCCAGTTGGAACACGGTGAACAGAACCT
       < K V D H G A A R L A W A L P V M C M Y H G A W N S V T F L V K

40160 TCATCGCAGCCTCTCTGTGGCCTGCCGAGGAGGTTGGGGGTCGCGGCCGGACCGGCTCAGGAGGTCAGGACCGGCAACTCCCGCGCGGGA
       < M                                                            S T L V P L E R A P

40250 TCGGGAACTCGATCACGATGTGCGCCGCACCGCGCCCACTGGTCGCCGAGGGGTTCGGCCCGAGCCGTACGTCGTGGACGATGAAGTC
       < D A F E I V I T R R W Q D S P N P G S G H V L R V D H V I F D

40342 CCCCTCCTGCGAGGGAGACCGGCACCGCGTGCGCGTGCGGCCGTCGTCGGGCAGCAGGTGGGAGCCGGGCACGC
       < G E Q S P V P V R R P G A D R V A T V D A D D P L L H S G P V G

40434 CCTCCAGAGACAGCCGTTCTCCGGGCGGTGTCCAGGCAGATGCTGCAGACCCGGTGCCGGGGGACGTTGACCCGGTCCCGGTGC
       < E L C G N E P G A T D L C I S I N C V A H P P V N V R D R H

40526 CACGGCCACGCCGGCCCGCAGTGGCTCCTTGAGCACCAACGCGAAGGCGGTGGGCACGACCGGGGTGCCGAGGACGTCGGCGGCCACCGC
       < W P V G A A R L P E K L V L A F A T P V V P T G L V D A A V A

40618 GGCGATCTCCGGCCGGTGCAGCAACTCGCCCTGCGGCCCTGCTTTCGAGGTTGTGGATCCGGTACAGACCCGGCTCCGCGCCCTCGA
       < A I E P R H L L E G Q P W D Q K E L N H I R Y L V P E A G E V

40710 CCTCGTAGTTCCAGTAGTCGCGGCCCTTGGCCGTGCGGCGTCCGACGCCGAACCGGCTGCATCAGGCTTACGCGGCCTTGAGCTGGCCAGCACC
       < E Y N W Y D A N A R A P G A F R D I L S V A G A K L Q A L V

40802 TCGGGGTCGAGCAGGTCTGCGAGCCCGACGTGCGCGATCCGTGCCGGAAACCGGCTGCTGCCCACGGCCCTGGCCCTCGCGCTGGTCATCG
       < E P D L V P G V H A I G D S R F R S A V A E R E R S M T T M
                                                                  < . R

40893 GAGGCTCACCCCCTTCGGTCGGTCGGCCGTCGGCCGTGCCGGTGCCGGATGATGTCGCACACCTCCGGCGACCGGCGCTCGTGCAGC
       < L S V G E T P R R T G T R R G V A I I D C V E P S R R E H L

40984 ACCTCCACCTCGGCGAAGCCGGCGTTGTGCAGGCGGCGGCGAACAGGGACTCCCGGCTCGAGCGCTGAGCGTCGACGTTGACCTGGCCTG
       < V E V E A F G A N H L A A F L S E R D L W R V D V S L G R A Q

41076 CGGCTCGGGGTGCTCCTCGTGCGGCGACCTGCTTGACCGTCGATCGGTTGCAGGTCGCCCACGCTCCCCAGTAGTGGGTGGAGAGGT
       < P E P H E E R V Q K V T Y G D I P Q L D G V G G W Y H T S L Y
```

```
41168 AGATTCCCGCGACGCCCGCGATGTCCTTCAGCAGGGTCCACGGCTCCACGCACGTGTAGAGCAGGCCCGCGCAGAGGACGGGGTCGAAC
      < I  G  A  A  V  G  A  I  D  K  L  L  T  W  P  E  R  V  H  Y  L  L  G  A  C  L  V  A  D  F
41260 TCGCCCAGCTCGGTGAAGTCGGACGCGCTCGACGTGCGGCAGCTCCACGCGTTGATGCCGTTCACCTCCATCACCAGCTCCGCGCG
      <E  G  L  E  T  F  D  I  R  E  V  D  A  V  R  L  E  V  N  T  I  G  N  V  E  M  V  L  E  A  R
41352 GCGCAGGTTCTCCGACGGCCCTGCAGGGCAAGCACGTCGTGCCGGGGTGCCGAGGGCAAGCGTGTCCGGCCTCCAGTGCGCCGA
      <R  L  N  E  P  R  G  E  L  A  L  V  T  T  G  P  H  R  A  L  T  D  A  G  E  L  A  G  L
41444 GTTCGAGGATCGCCGCGGTCGGGAAACGCACCGAAGAACTTCGGCGCCGGTCGGCCGGGGACTGGCTCAGCAGATAACCGTGCTGGGAG
      < E  L  I  R  R  A  D  P  F  A  G  F  F  F  K  A  A  R  D  A  P  S  Q  S  L  L  Y  G  H  Q  S
41536 CCCTCGGGCGTAACGCACTCCGTGCTGAATCCATTGCGGTTGCGGACTAGTGTTTTCATCATATTCAGCGGCTCGCCGTGCTGAGCCTTTGTTGACCAGCCG
      <G  E  A  Y  R  V  G  D  H  E  F  G  N  V
41627 GATCAAAGCCTAGCGATGCCATTGCGGTTGCGGACTAGTGTTTTCATCATATTCAGCGGCTCGCCGTGCTGAGCCTTTGTTGACCAGCCG
                                              <-  R  S  A  T  S  L  R  E  N  V  L  R
41718 GGCCCATTCCGGAATCCGGTCCCGCGATCTCGATATCGAAGGACGACTGGAGTTCCGCCGGCGTCGGCCGGCGCCACCTGGCGGTGC
      <A  W  E  P  I  R  D  G  G  I  E  I  D  F  S  S  Q  L  E  A  P  G  A  D  A  A  W  R  A  T  R
41810 GGGCCAGTCCTCGGCCAGCGGGGTGTCGTTCCGAAGACCGATCGGCCGAAGACCCAGCTCCGTCGCGGTTCGCACCTCGTCC
      < A  L  G  E  A  L  P  T  D  T  W  D  G  F  V  S  R  A  L  E  T  A  T  Y  A  T  R  V  E  D
41902 CGGGACGGGCAGGTGGGGCGATCGACATGCTCCGGGCACGCGGCTACCGCTGGGCGTACCGGTTGTTGGTGCTGCTGACGA
      <R  S  P  L  H  A  I  P  H  E  P  V  G  A  A  S  R  V  A  Q  A  L  E  L  V  T  N  T  S  S  S
41994 GCCCACGTTGAATGCCCGCCTCGGCGTCCTCGGCGGCCGCCTCGGTCTCGGCGCCTCGGCGTCTCGGCGGCGTACGTGAACGCGGGA
      <G  V  N  F  A  R  G  W  A  A  E  T  E  A  A  R  S  V  N  V  V  D  G  V  Y  T  F  A  R  V
42086 CCTGGCCGCCGTCGCCGTCGCCGTACACGGTGATCGGCGTAGAGGATCTGGTTGAAGAAGATGGCGACGCGTTGCCGGTACGGGTCCCGCATG
      < Q  G  G  D  G  Y  V  T  I  P  E  G  R  L  I  Q  N  F  F  I  A  V  N  R  Y  P  D  R  M
42178 TTCTGCCACTCGCCGTAGACGTTGTGCATGCGGAAGGCAGCCCTGGGTGAAGGCGGTGAAGGCAGCCCTGGGTGAAGGCGGTGAAGGCTGCGACCAG
      <N  Q  W  E  G  Y  V  V  N  H  M  R  F  A  T  F  P  L  G  Q  T  R  M  T  V  E  L  E  R  E  V  L
```

FIG.11A(37)

```
42270 GTACTTGGCCAGGGCCGTAGCTGTCCGCGGGGACGGGGACGACGAGGACTCGCGCATCGGCTCTCGCGTGGCCGTCTAGACCGCCCACGGAGGAGG
      < Y   K   A   L   G   Y   S   D   A   P   V   P   V   V   S   E   R   M   P   T   E   G   H   G   Y   V   A   V   S   S   A
42362 CGAAACAGAAGAACCGCACGCCGGTACGCAGCGACGCGTTGATCAGATTTATGCTGCCATCACATTGGTGCCGTAGTTGAGCTGCTTCACC
      < F   C   F   F   R   V   G   T   R   L   S   A   N   I   L   N   I   S   G   M   V   N   T   G   Y   N   L   Q   K   V
42454 GAATGGCTGATGCCTCCGCGCGAAGGCGGCCAGTCCACCCGCAAAGTGGAAGACCCGCTGGAAGCAGTGGTTCTCGGCGAACAGTGAATCGACGAAGTCCACGTC
      < S   H   S   I   A   E   A   A   A   F   A   A   F   H   F   V   R   E   F   R   N   E   A   F   L   S   D   V   F   D   V   D
42546 GGTCACCGACGCGAACGACGGCCAGTTCCACCCGGCCGGGAACCCGCTGCCGCGCTGAGGTCGTCCAGAACGGTGACCCGGTGCCCAT
      < T   V   S   G   V   A   L   D   V   G   A   P   V   R   Q   R   S   G   G   S   L   D   D   L   V   T   V   R   H   G   N
42638 TCCTGACCAATGACTCCACCAGGTGCGAGCCGATGAATCCGGGCGCGCCCGATCTGCGGGGCGATCTGCGGGAGGGAGGTGTCCTGCGTC
      < R   V   L   S   E   V   L   H   S   G   I   F   G   A   G   G   T   V   L   C   R   V   M
42728 GATCCGGAAAGGTTGACCGAGCGGCCCTTCGTCGGCGAACACCGAACCCCGAGAGAAAGCTTCGCCTCAGGGCAC
                                                                                        < .   P   V
42819 CGGCGACCGGTCGGCCTGCTTCTTCAGCGGCTCCCACCAGTCGATGTCGTCCGGTACCAGTCGATCGTCTCGGCCAGGCCGTCGGGCGAAGG
      < P   S   R   D   A   Q   K   K   L   P   E   W   D   R   H   T   R   Y   W   D   I   T   E   A   L   G   D   A   F   A
42911 CGACCTCGGGGCCGGTAGCCGCGGAGCCGCCCAGTTTCGCGTCGTCAGCGAGTAGCGGGTCGTGGCCCTTGCGGTCCGGCCACCCGCTCGACC
      < V   E   P   R   Y   G   L   A   R   L   K   A   D   T   L   S   Y   R   R   D   H   G   K   R   D   P   V   R   E   V
43003 CGGTCCCACCCGGCCCCCAAGGCGTCCAGCAGCGTCAGCTCCATGTTGGACAGTCCAGCTCAGCCGTGCGGCGATGTGGTAGACCTCGCC
      < R   D   W   G   A   G   L   A   D   L   L   R   G   T   L   E   M   N   S   L   E   A   T   G   A   I   H   Y   V   E   G
43095 GGGGACACCGGCCAGCCGTGACGAACAGCCGTCTGGATGCCCGGCAGTGGTCGTCACGTGGATCAGTCGGACGTTCCCGCGTCGCGGTACAGCG
      < P   V   G   R   D   V   T   Q   I   G   R   C   H   D   T   V   H   I   W   D   R   V   N   G   G   D   G   Y   L   P
43187 GCACCCGCGCCGTTCAACAGCTCGGTGACGAACAGCCCGGGGATCAGCTTCCGGAAACTGGTACGGCCCGTAGTTGTTGCCGCACCGGGTG
      < V   R   R   G   N   L   L   E   T   V   F   L   P   I   L   K   E   P   F   Q   Y   P   G   Y   N   N   G   C   R   T
43279 AGGCAGACCGGCCAGCGGCGTGGGTGCGGGCGTAGGCGGCCAGGGCGATCAGGTCCCCGCCCTTCCGCCGCCTTCGGGGGAGTTCGGCGCCAG
      < L   C   V   P   L   G   H   T   R   A   Y   A   L   A   I   L   D   G   G   A   K   A   A   A   Y   P   S   N   P   A   L
```

FIG.11A(38)

```
43371 GGGGGTGTCCTCGGCCAGGAACCCTCGTCGATGCTGCCGATGACCTCTCGTCGGTGGAGACCTGGACCACCCGGGCGACCCGGGCGTCGAGAC
       < P  T  D  E  A  W  S  G  E  D  I  S  G  Y  V  E  D  T  S  V  Q  V  V  R  A  V  G  A  D  L  C
43463 ACGCCTGCATGAGCGTCTGGACGCCCTGGTGCACGTTGGTGCGGACGAACTCCGGCGAGTCGGCGGTGGACCGGTCGACGTGCGACTCGGCGGG
       < A  Q  M  L  T  Q  V  G  Q  V  N  T  R  V  F  E  A  S  D  A  I  S  R  D  V  H  S  E  A  A
43555 AAGTTGACCACCACGTCGTGCCGGGACAGCACCTCGGCACTCGGCCGTGTCGCAGAGGTCGCCCTTGTCCAGAGAAGGTGATCCGGTTCTGGAC
       < F  N  V  V  D  H  G  P  L  V  E  A  L  L  A  T  D  C  V  D  G  Q  V  F  T  I  R  D  Q  V
43647 CGGTTCGAGGTTGGCGAGGTTGCCCCGCTACGTCAGTTGTCCAGCACGTTCACCCGGGCCTGTCGCCGTGTCGGGGTAGGCACCGGTGGCCA
       < P  E  L  N  A  L  N  G  A  Y  T  L  K  D  L  V  T  R  A  Q  A  T  D  P  Y  A  G  T  A  L
43739 GGTCGCGGACGTACTGCGAGCCGATGAAACCGGTGACCCGGTGACCAGGACGCGACCATCAGACGCGATCAGCAGGACGCATCCGCTGTGAT
       < D  R  V  Y  Q  S  G  I  F  G  A  G  G  T  V  L  V  R  R  M                  V  G  V  R  V  E  S  H  D
43828 CGCCGAGGACGAACCGGTGCGTCTTGGGCCACCCGGGGACCACCCCGGGCGACCCTCCCGGCGATCGAGAACTCGATGCGGCCGATG
         G  L  V  F  R  H  T  K  P  V  R  P  G  P  V  V  R  A  E  R  G  I  M  S  F  E  I  R  G  I
43920 CCCTCGATGTAGGCACCCGCCAGAACGATGGAGTCTCCGACCACCGGACCGATCGGGCGACCGCCCGGGAGCCCTGACGTCGGCGCCGATCACCACCG
       < G  E  I  Y  A  G  R  L  V  I  S  H  E  I  E  T  E  L  L  T  C  D  C  D  I  S  T  Y  P  G  L
44012 GTAGGAGTTGCGGATTCAGTTCGGTGCGGTCGTGCGACCTTGCCCTCGACCAAAGGCTGCCGAGGACTGCCGGTTCATCTCCAGCATGTCGGCG
       < Y  S  N  R  I  I  S  G  A  G  V  V  V  P  G  V  V  I  R  S  G  S  V  D  A  G  A  S  I  V  V  P
44104 GGCCGATCAGTTCGGTGCGGTCCTTCCAGTAGCCCGTAGCCCGTGATCATGTGGAGTGGCCGGCGTCGATCATCCACTGCACCGGTGGTGATCTC
       < G  I  L  E  T  R  D  D  V  K  G  E  V  L  P  E  V  S  G  L  V  F  R  N  M  E  L  M  D  A
44916 AGGTTGCCGGTGTCCTTCCAGTAGCCCGTGATCATGTAGCCCGTAGCTCGATCATGGAGGAGCTGAAGACGTAGACGGGCCAGGTCGCT
       < L  N  G  T  D  K  W  Y  G  T  I  M  T  S  D  V  R  H  G  R  D  I  M  W  Q  V  A  D  T  I  E
44288 CAGCTCGTTGCCAGGACGGCTTCAGCTGCCGACATGTGGACACCATGTGAAGACGTAGACGTAGAGACGTAGACCCGACCAGGTCGCTCT
       < L  E  N  R  W  S  P  K  L  E  A  V  A  D  H  V  V  P  S  F  V  Y  V  G  V  L  A  L  D  S  K
44380 TGGGGTGCTCGGCCTTCTCCTCCACCCCGATCACCCGGACGCCGAACGCGGTGCGGGTCGGGACCCGGGTC
       < P  H  E  P  K  E  E  V  G  I  V  R  G  D  A  G  M  E  A  V  G  F  A  H  P  D  A  V  R  T
```

FIG.11A(39)

```
44472 AGCATGATCTGCGCGTGCGCTGCTCCTGCGGAAGGCGCTCGAGCGATGTCCTTGATCCCGCCGACGATGAAGTTGTCGCGAGGTACATGAG
       <L  M  I  Q  A  H  P  R  E  Q  R  F  R  E  V  I  D  K  I  G  G  V  I  F  N  D  G  L  Y  M  V
44564 GAAGTCGTCGTCGCCGAGGTAGTGCGCGGAGATGAGCACGGCGTGCCCAGCCTCCTGCGAAGGTAGTCACCTGGAGGC
       <F  D  D  D  G  L  Y  D  R  S  I  L  V  A  H  A  L  G  R  P  A  E  Q  P  L  Y  T  V  Q  L  G
44656 CGAACTGGGAACCATCGCGGACCAGCGCTGAATTTCGGGCGGTGTCGCCGACGACGATGCCCACCTCCTCGATACCGCCTCACGAATA
       <F  Q  S  G  D  G  V  V  R  Q  I  E  P  A  T  S  G  V  V  I  G  V  E  E  I  G  G  E  R  I
44748 GCCTCGAGCCCGTAGAACAGCACGGCTTGTTGGCCACGGGAATGAGTTGTTTGGCGACGTGTGGGTGATCGGACGCAATCTCGATCCCAC
       <A  E  L  G  Y  F  L  V  P  K  N  A  V  P  I  L  Q  K  A  S  T  H  T  I  P  R  L  R  S  G  V
44840 CCCTCCCGCCAGGACCCTTCAGGAACGCCCTCGAAAAGGATGGAACGGAGACGGGTCGCTGGTTCACGAGCACTCCAGGGGTCACGG
       <G  G  A  L  V  L  A  K  V
44931 TGGACTGGGCTCTTCGTGAAGCTACGAAGGATCACTCGTGATTTCCCTACCTTATGGGCCACCGAGGTGTGATCGGTGATCTCTATGCGT
                                                                                             <  ·  A  D
45022 CCGCCATTTCCGCAAACGGGGACCTGGCCGGCCGGCCCCGGACCAGTTCGAGCACGGCCAGGCCGTGCACGGTGTCCGGGGCTGGCC
       <A  M  E  A  F  P  P  R  A  P  G  G  G  V  L  E  L  V  A  A  L  G  H  V  T  D  P  P  S  A
45114 GGCAGCAGCAGGGTCTGCAGGGCGTACACCGCCTCGGCCGACGTGTCGCCACCATCAGCGCCGTCCTCGGGGCGACCTTCAG
       <P  L  L  T  Q  L  G  A  Y  V  A  G  G  D  A  L  T  D  G  V  M  L  A  R  E  P  A  V  K  L
45206 CTCGTCGCAGGCGGGTGCGGAAGATCCGGAAGTTGCTGACCACGCGATGTTGCTGACGACGTCGTTCCACCAGCTCCGCCATCC
       <E  D  C  A  T  R  F  I  R  P  D  P  K  V  A  G  V  E  H  S  F  V  Y  A  D  V  L  E  A  M  G
45298 CGTACGCCGCGAAGGTCGGCAGGTGGGCGTGCAGGTTGCTGACCAGCGAACAGCCGGTCGTGTAGAGCCGCCGGCGATGGGGACCGGG
       <Y  A  A  F  T  P  R  L  D  W  A  I  N  S  V  V  A  T  G  C  G  R  R  L  E  A  L  V  P
45390 GCGGGCCGTCGGCTAGGGCGCAGGGCAGGCCGGGATGGGCAGGTCGACGGTGGA
       <A  A  D  R  Y  P  L  W  G  D  T  R  F  L  R  D  Y  L  A  E  A  L  G  P  H  P  L  D  V  T  S
45482 GAGCAGGCCGAGCGCGTACGCGCTGCGGTGCGTTTCGGGCGAGAGGTCCGGCGAGCCCGGCGGGACCTCGGACGGTGCCGCT
       <L  G  V  Y  Y  A  S  R  H  T  E  P  S  L  D  R  R  A  Y  V  E  A  L  G  P  P  V  A  H  P  E
```

FIG.11A(40)

```
45574 CCGGCCCGCCGGGACGGCCGGCCGCCCAGCAGCAACCCGGTCAGGGCCTCCTGCTGCCGGGTCGAGCCGTTGGACGCCGACGGTGGCCGCCGCC
      < P  G  G  P  R  G  A  A  L  L  G  T  L  A  E  Q  Q  A  P  F  L  Q  V  G  V  T  A  A  A
45666 GCCCGCAGCCAACGCTGCGGCAGTTCCACGGCGAACAGCGTGCCGGAGAAGTCGAACAGGACGGCGTCGATCGGACGGGCAGGGGGTCGT
      <A R  L  W  R  Q  P  L  E  V  A  F  L  T  G  S  F  D  F  L  V  A  D  I  P  R  P  L  P  T  T
45758 CATCGCTCTCCTCGGTGCAGCGCGGTCAGGGCGGCCACCAGCCTGGCAGCGGACCGGATGTCATCATGGAGGAATGCGCCGGGTCG
      < M
45848 GGCGCGACCCGCCATGGCGCGCCGGTCCGGACGACAGGCATTTTCGGTCACTCTTGCCCTTCTAGGCGATTTCTTCAAAGATGGCTGTCAATTC
                  > V  T  R  T  R  T  A  L  R  R  L  L  A  A  G  L  A  S  L  A  T  A  A
45940 TTCAGCGATCCTGGAGGCATCCGTACCGACCGGCCCTGCCGCCGTCGTGCCGCCGCCCTGCCAGCTCCGCCGCTGC
      > V  T  R  T  R  T  A  L  R  R  L  L  A  A  G  L  A  S  L  A  T  A  A
46030 CGCGACCCTCGTCGCCACCGGCCCGGCCGCCATCGACGTGTCCCACTACCAGGGATCGATCAACTGGACGA
      > A  T  L  V  A  T  G  P  A  A  A  T  T  P  G  I  D  V  S  H  Y  Q  G  S  I  N  W  T
46122 GCGTCCGCAACGCGGGCATCCAGTTCGCGTTCATCAAGGCCACCGAGAGGTACACCAGCTACAAGGACCCCAACTTCAACGCCAACTACGTCAAC
      > A  V  R  N  A  G  I  Q  F  A  F  I  K  A  T  E  G  T  S  Y  K  D  P  N  F  N  A  N  Y  V  N
46214 TCCTACAAGCGCGGAGTGATCCGCGGAGCGTACCACTTCGCCCGCCCGAACATCTCCTCCGGCGCCACCCAGGCCAACTACCTGGCCAGCAA
      > S  Y  N  A  G  V  I  R  G  A  Y  H  F  A  R  P  N  I  S  S  G  A  T  Q  A  N  Y  L  A  S  N
46306 CGGCGGCGCCTGGTCGGCGGACAGTCGGCTAGCTGCACCCTGCCGGCCGCCGGCTGGAGGTCAGCGGCCAACCCGTACAGCGGCGGCACGTGTACGGCCTCA
      > G  G  A  W  S  A  D  S  R  T  L  P  A  A  L  D  V  E  A  N  P  Y  S  G  G  T  C  Y  G  L
46398 GCACGTCCGGGATGCGTAGCTGGATCCAGGACTTCCTGAACACGTACAAGGCCCGCACCGGTCATCTACACCACGAGC
      > S  T  S  G  M  R  S  W  I  Q  D  F  L  N  T  Y  K  A  R  T  G  R  Y  A  V  I  Y  T  T  S
46490 TGGTGGAACCAGTGCACCGGTAGCTGGACGGGCCCGTGGGCCAACCACCCGCTGTGGCTCGCCCGCTGGTCGAGCACCCCGGGCACCCTGCC
      > W  W  N  Q  C  T  G  S  W  T  G  P  W  A  N  H  P  L  W  L  A  R  W  S  S  T  P  G  T  L  P
46582 GGCCGGCGCTTCGGTCTGTGGAGCTTCTGGCAGTACGGGCTCTCCGGGATCAGCGGCGAACGTGACCGGCAACAACTGGAAGG
      > A  G  A  S  V  W  S  F  W  Q  Y  T  A  S  G  S  V  S  G  I  S  G  N  V  D  R  N  N  W  N
46674 GCGACCGGACGCGACCGGCTGATCGCCCTGGCGAACACCTGACCGGGTAGGCGGTTGGCGGCAGCCCGAACGCCGAACAACTGGACGGT
      > G  D  R  T  R  L  I  A  L  A  N  N  T  .
```

FIG.11A(41)

```
46765  ACGGTCGGGGCCGGTCCGGCTGCCGCTCACCCGGCCCAGCCCGGTGCCCCAGCCCGGCATCCGGTCCTGCCGGGGTGGCC
46857  CGCCGTGCCATCCGCCAGGCGGCCACGCGCCTGCGAGCGGCCGGCCACGACCAGCGGAACAGCGGAAGACCCGCGCTGACCAG
46949  CAGCAGCACCACGTCGCCGAAGGCGAGAGCATCCACAGTGCCCGGGTCGAGCGTCCCTGCTCGTGTCCATGTCGCACCTCCTCG
47041  CATCGTCCGGGATCAGATACCCGTTCGACGCAAGTACATGCAAGTCGAATCGACATCGCCTGCTCAGCGGGGCGAGTCGGC
47133  AATGGACGGCCCCGGGCGCTCAGTCGACCCGGTCCGGCTTGAAGCCCTTGGCGATCGGCCAGCGCGCGCCTGCCAGT
          <  ·  ·  D  V  R  D  P  K  F  G  K  A  I  R  D  F  D  A  L  R  A  Q  W  D
47224  CCTTGTTCGCGCACTCCCACCGGAGGGCGTACCCCGGTTGCGCGTGACGAAGCCCCGGTTGCGGACGTGGATCGAGTGCCGTCCGG
          <  K  N  A  V  E  W  R  L  A  Y  G  R  N  S  A  T  V  F  G  R  N  R  V  H  I  R  T  G  D  R
47316  TTCTCCAACCACTCCCAGTCCGCGCACGTCTTGTAGTAGTCGCAGCGCTTGATGCTCAGATACTGGTAGCCGTTGACGTAGTTCTTCCGGGC
         <N  E  L  W  E  D  A  C  T  K  Y  Y  D  C  R  K  I  S  L  Y  Q  Y  G  N  V  Y  N  K  R  A
47408  CGGTTCCTTCTCTTTCCAGTCGGGCGTAGGCGTGGTCGCCCTCCGGGGTGCTGGTCCACTGCACCAGCAGCTCGCACCCCGTCGCGCTCGTCGA
          <P  E  K  E  K  W  D  A  Y  A  D  G  E  P  T  S  T  W  Q  V  L  L  E  G  V  G  D  R  E  D  F
47500  AGACGATCGTGTTCTGCCCCACGGGCCGTTCGGGGTCCACGGGACGGGCTGGCAGTCAGGGACCCTTCGGACGCGCTGGGCTGTGCTGCCGGTGTCTTGTCAGGAGCCAACCC
          <  V  I  T  N  Q  G  V  S  R  R  V  W  G  K  P  L  P  L  S  F  G  A  P  D  K  H  L  L  W  G  ·
47592  TCGGGCAGGGGCGTTCGGGGTCGGGGTCGCCCGCCTGCGCGGGGCCCCCGGGTCCTCGTCACCGGCTCCGGCCCCGAGCAGCACCGCCAGCAGGCCGA
          <E  P  L  A  N  P  D  V  S  P  S  A  S  P  T  P  S  P  P  A  A  S  S  T  A  P  A  A  S  P  T
47684  CGGCGTCGACACGGCCCGTCCGCCCGGGCCCCAGGACCTTCGTGCCCCCGACGACGGTTGGCCCGGCCGTCGAC
          <P  T  S  V  G  A  Q  P  D  G  G  P  D  D  D  G  S  R  G  L  L  P  V  A  A  L  L  G  I
47776  TCAGCAGCACCGCGACGAGCGCGCCGACCAGCGCGGGACGTCGGGGCCTCCTCCGCCGGCGGCCTCGCGGGCGGCTCGCGGGCGGGCGG
          <  L  L  V  A  V  L  A  G  V  L  L  G  R  R  R  R  E  P  K  T  G  G  V  V  T  A  R  G  T  S
47868  GAGAGTGCCGGGCCGGAGGCCGGCAGCAGCGACGTGGGGCAGCTTCGGCTCGTGTCGTCGGGTGTCGTCGGGCCGGCCCGGGAGGCCCGGGGCC
          <S  L  A  P  G  S  A  A  P  L  V  S  T  P  A  A  E  E  R  P  A  V  A  P  E  R  A  P  P
47960  CGAAACGGGCCACAGCCCGGCCCCGGATCGACCCGGGTCGTCGTCGGACAGCGATGGAGCGGGGAGGGGACCCCTT
          <S  V  P  V  A  A  G  P  D  V  R  T  D  D  A  R  T  D  D  A  R  G  A  A  P  A  G  D  A  G  E
```

FIG. 11A(42)

| Position | Sequence | Translation |
|---|---|---|
| 48052 | CGTCCCCAGCCTCGGCGGCGGCCCGTCGCCGGCGGCCCGTCACTCCCTCCGGCCGGCGGTGCCGCCAGCCTCGTCGGCGCTGGTCGCGGCGGTCG | <D G A E A A R D A P P G D S G G A P T G A A E D A S T A A D |
| 48144 | GGGGCGGGGATCTTCGCGGTGGGAATCGGCCGCTGCGGGCCGAAGTCGGTGACCTTCGCGGTCGGGGCTCGGCAGGTCGAC | <P A P I K A T P D A A Q P G F D T V K A T P D A D A S P L D V |
| 48236 | CATCGCGGTCGGCGCGGGTCCACCCCGCCGGGACCTTCGGCGTCGCCGGCGCGCCCACGCCGCCGCCACCGGCGGCGGCAA | <M A T P A A D V G A P V K A T A D G G G V G A A A A G G A A L |
| 48328 | GACCACCTTCCGGGGTACGGCGGTGCGGGGCCGCGGCCGCCGGCCGGTGCGCGGTTCGGCGGGGCGCGGTGCGGGCGGTGC | <G G E P T R P A P P A A P R G T R Q E A P R P A P V V P P R |
| 48420 | GGCTCGCGGGCCGTTCGGCCCCGGCCGTTGCGGCGACGCCGTCGAGCAGCAGGAGATGGTCTTGGCGGACGCCGGCGCCGGCGGTCGCCGCAGGAGCCG | <P E R P G N P G P R R V G D L L S I T K A R R G A A R R L L R |
| 48512 | CTCGGCCACCTCGGCGTCGATCCGCTCGGCCCGCTTCAGCAGCCCGTTCAACGGCGCGGTCTTCCTCGGCGGCG | <E A V E A D I R E A P D K R L L G N L V P K L P G A N R P P P |
| 48604 | GCATCGGCTCGGTGGCCAGGCTGGCGACGATCGCCGTCCCGCGCGACTGCCCTCCACGCGTCGTAGAGCGTCGCG | <M P E T A L A A L T A I A S P R A F P S K G E V A A Y L T A |
| 48696 | CCCAGCGACGACCAGAGGTTCCGCCTCCGGCCGGCCGGATGTACGGCCGATGTAGCCGGGGAGCCAGCACCATTCCGGT | <G L S W L D A E P G A T G D R A R E P A I Y A P S G L V M G T |
| 48788 | CCCGGTCACGTTCGGGTGACCAGCCGGGGATGGTCGCCAGGCCGAAATCGGTCAGCACCACCCGGCCGTCGGTGCCGAGCAGCAGCGTTGCCGGCT | <R T V N P D G P I T A L G F D T L V V R G D T G L L V N G P K |
| 48880 | TGATGTCCCGGTCATGACGCCCGGCCTTGTGCGCCGCCTTCAGCGCCAGCACCTCGAGATCTGCAGCGCGATCGACACC | <I D R H M V G A K H A A K L A G L V G L G I E V A K A P S V |
| 48972 | GGCCCCGTCTCCGCGAGAGTGTCCTGAAGGACTTGCAGCGCCACGTACTCCATGACGATCACGGGTCGCCGTGGCGCAGAACGTCGAA | <P G D E A L T D Q L S K S A V Y E M V I W P D G D T R L V D F |
| 49064 | GATGCGGACCACGTTGACGTTGGTTGAGTCGCGATGGCAGCGCCTCCGCCATCTCGCGGAGCGTTCCTCCCGGGGTGA | <I R V V N V H N L R A I A R A E R L S R E R M E R E E P T L |

FIG.11A(43)

```
49156 GGCTGGGCGGGGACCAGTTCCTTGATCGCCACATCCCGGTGCTGCGCGCCTTCCATACCGACCATGCCACCCTGACC
       < S   P   P   P   V   L   E   K   I   A   V   D   R   H   L   V   E   D   R   A   K   W   V   R   G   M
49247 GAGCGGCGAAATCAGCCGGTACCGGTCGGCAACGAGTTGGGGAAGGCGGTTCGACATCGGTGGAGACGGTACCCGGCGGCGGCCCGCGCAC
49339 ACCGGCCGGCACGCCACTGCCGCCGAGGAACTGGCCGCGCTGGTCGGCGTACGCGTCGCCGGACGCGTGAACGGACGCGTGTTCCGGTGACCC
49431 GGGGCGTTCCGACGCGCCAGCGGTCGGCCGACCGCGCTCATCGTCGCCGGACCCGCTGCCGCGCCGCCTCCGGTCTCCGCTGCCGCGCCG
49523 TCGGCCTGGGCACGCGCAGCGGTCGGCCGCCGGCGGTGCTGCGGGGTGGGCGGTGGGCGGGCTCCGGAGGTGCACCACCCGGTCTCCGCTGACGCAC
49615 TCGCCAGCATGTGCCAGTGGCCAGTAGGGAGGGTCGATGATTCCCGAGGAGGACCGACCACCCTGGTTGAGCGCTACGGCAGCATCGAGGCCGAC
49707 GACGATGCCGTGACGGATAGGGAGGGTGCAACTGGTGCAGTTCCTCAAGGCGCACACGCGCATCGTCGTACATAGCGGACAGCATGAA
49799 ATCCGCCAGATGCGCGAGTTGCGCCGACGCCTTCGTCGAACTGCCACCTGGCCAACCCCGCCGGGGATCGCGAGCAGTACGCCGACTCCGACGCCTTCTCCGCCT
49891 GGCACAGATCCCCAACCCGCGACGCTTCGTCGAACTGGTGCAGTTCCTCAAGGCGCACACGCGCATCGTCGTACATAGCGGACAGCATGAA
49983 TCTGGTCCGTCGGTGGGGCCACGGCCACTGGCCAACCCGGACCCTCCTGCCAACCCGGACGCCTCTGCCCGACCCAGCCGGA
50075 CGGGTCTCCGACGTGGAGCGGGGCGGGTGGTGCTGCCATGATCGAGCGGGGCAGCGGCGACGTCGCGGCCTCGGCGCCTCGGGCCTGGGACCTCGCGGCAGGCCCACC
50167 CGGGGGCCGGGGGCGGGTGGTGCTGCCATGATCGAGCGGGGCAGCGGCGACGTCGCGGCCTCGGCGCCTCGGGCCTGGGACCTCGCGGCAGGCCCACC
50259 CATGTGGCGTGCATCCAAGGAGTACCGGGCGCGCTGCCAGCGCGTGGCCGAGCAACGCGCCCTCGGCGGCCACCGAGCGATCAGCAGCGCCCG
50351 TGGGCCGCCTCAAGGAGTACCGGGCGCGCTGCCAGCGCGTGGCCGAGCAACGCGCCCTCGGCGGCCACCGAGCGATCAGCAGCGCCCG
50443 GACCTGATCGACAAGGTGCAACGCGTCGCACCCAAAACAGGTCCTGTACTCGGGAGACGGGAATCGGGACGGGAAACACCACTTCGCCATCGGCCATCCCCGGC
50535 CACCGAACTCAAGCCGCTGCCGGACAAGCAATGCTCCGGACTGACGCCGGTACTGGAGAAACTCCAGTGGAACGACTCAAGCCGCCAGGCCGAACCTGATGTACGGGTTGAGCGGC
50627 TGGGCAGCCGCTGCCGGACAAGCAATGCTCCGGACTGACGCCGGTACTGGAGAAACTCCAGTGGAACGACTCAAGCCGCCAGGCCGAACAACCCGGATGCTTACGAGAGCAC
50719 GAACTCAACAGGCCGGACACGCCCAGCCATGTCCCGGTATTACCAGTCCCAACCATTAGGCCTTCAATTCCCTCAAGCGCTCAGCAAGCAGAGCCACGCCCTG
50811 AGGCACGCCTCCGGTCATCCCGCCGTATTACCAGTCCCAACCATTAGGCCTTCAATTCCCTCAAGCGCTCAGCAAGCAGAGCCACGCCCTG
50903 TTCCTGTCCAGAGCGCACCCCAAAACAGGTCCTGTACTCGGGAGACGGGAATCGGGACGGGAAACACCACTTCGCCATCGGCCATCCCCGGC
50995 ACCGGCCACCCCAGTGACATCCAACCCGGACAGGAGGGTGCTGCCCTACCCTCCCCGCGAACTTGCCACCTTGCCACCTTGAGGGGTGCATCGCCCCCACTGGACGAGG
                                                                                            junction marker
51087 CAGCACAACCGGCCAGGTAGGAAACCAGCCCGCTCAACACGTCCTCACGACCATTCTTGCCAGGCGGCCTGATCGGCGGCGGGCCCGCGA
51179 TGGGGATTAATCAACCCCTTGGCAATACTCCTCCGGAAGGATCAACCCAATTGGAGGGGTGATCGGGGGCGGTGGGCTGGAACCTCACCA
```

FIG. 11A(44)

```
51271  ACCGGCGCTGCAGGCACTCGCCGGGCTCGGGACGTGGTTCCCCACTTTAACCTGACCCCTGCGGCGCCTCGAATGGCGCACCGCAAGGCGT
51363  CGTAAACACCTTAGGTCTGAATGGTGAGCGCGTCACGCTCATCCACGCGAGCAAGGCGATACTGACGGCCGTACTGGGATCCCGACCATC
51455  CATGGGCAACCAGCGAGGGCGTTCCTCCAGTAGTCCGCCCCGAGGCGGAGGACCAATCGACCAGGGCCAGTATTGGCTTCGACCGG
51547  TGAAAACGCTCCTCCAGGGCGCTACCTTCACCTTCCTAGCAACATTGATGGTTGCATCAGCGTACGCCCCGAGCGCCGTGCCGTGCGA
                                                                                                >   V   R   A
51637  GTCCTGAAACCGATGTGCCTTGCGAATACGGGCTGGCACCAGTGGCACCTTAACTACCTGAAGGCGGCGGAGGCTCAGAAGCTGTCACTGGGA
      > S   P   E   T   D   G   A   L   R   I   R   A   D   Q   W   H   L   N   Y   L   K   A   A   E   A   Q   K   L   S   L   G
51729  GAAGGGGTTGTAGTAGCGGTCCCGGATACTGGCGTTGATCCACACCCCGACCTTCAGCGCCAATCTAATCAAAGGGATTGACATCATTCCGG
      > E   G   V   V   A   V   P   D   T   G   V   D   P   H   P   D   L   Q   R   N   L   I   K   G   I   D   I   I   P   G
51821  GGGCAATGGCGAGATGGCCAGAAGATCGCAACAGTCACGGCACTAGCATGGCACTGATAGCTGCTGGAAATCGCCAGCCCACGGACAGGGCCAGAGCGGCGCCT
      > G   N   G   D   G   Q   K   D   R   N   S   H   G   T   S   M   A   G   L   I   A   A   H   G   Q   G   Q   S   G   A
51913  TAGGCATAGCACCCAGAGCCAAGATCATGCCAATCCTGTCTTCCGCGTCGAACAACCTCGGTGATGCAGACGGCTTGGCTGCGGGTATAGAA
      > L   G   I   A   P   R   A   K   I   M   P   I   L   S   S   A   S   N   N   L   G   D   A   D   G   L   A   A   G   I   E
52005  TTTGCAATCTCGCATGGGGCGGATGTCATCAATGTCTCCAGGTTCGACTCATCAAGGCAATCAGAGAGGCGGTCGC
      > F   A   I   S   H   G   A   D   V   I   N   V   S   S   G   G   A   S   V   R   L   I   K   A   I   R   E   A   V   A
52097  CGCAGACATTGTAGTTGTCGCAGCAAGGGAGAGCATGTCCGAAGACAGTCCCGAAGACAATTGGCTATCCAGCGAGGAAGGAGTCGTCGCAGTTG
      > A   D   I   V   V   A   A   A   G   N   S   P   E   D   M   T   I   G   Y   P   A   S   E   E   G   V   V   A   V
52189  GCGGAATTGATCGACAGGGAAGTACTCCAAAGGCACGTCCAGTGCCACAGGATCGGCACAGGATCGGCACAGGCAGTCGACATCTACAGCACC
      > G   I   D   R   Q   G   E   H   A   S   V   S   V   V   G   P   E   V   D   L   V   A   P   A   V   D   I   Y   S   T
52281  AGTTACGACGGGAAGTACTCCAAAGGCACCGGTAGTCCAGTGCCACAGGATCGGCACAGGATCGCCTGCTCTGGTCGATCGAAGTTTCC
      > S   Y   D   G   K   Y   S   K   G   T   G   T   S   S   A   T   A   I   V   A   G   A   A   A   L   V   R   S   K   F   P
52373  CGACCTGCCCGCTCGGAGTCGTCGTCCATGCCTGCCATGCAGACAAAGGGCGCGCAGGGCACGACGACCAGTACGGCTACGGCG
      > D   L   P   A   S   E   V   V   H   R   L   T   A   T   A   I   D   K   G   P   P   G   H   D   D   Q   Y   G   Y   G
52465  TTATCGACCTGGTTGCCGCGCTTACGGCCAGACGTACCCCGGTGGCTTTGAGTCGGGACGGGACGTGCCCGACGTGCCCGACGTGCCTGGGTCGACC
      > V   I   D   L   V   A   A   L   T   A   D   V   P   P   V   G   F   F   E   S   A   T   A   D   V   P   D   V   P   G   S   T
```

FIG.11A(45)

```
52557 ACGACGGCGGTCGCCGAGCCGGCAGGCGAGGGTGACGATGGGGCAAGGGCCCGAGGTCTGGCCACGTTGGGAGTGATCGTGGCTGCTGCGGG
      > T T A V A E P A G E G D D G A T A R G L A T L G V I V A A A G
52649 CGCTTGGGCGCTGGTCGCTCGACGGCGTAGGTTGAGCGACGACCCCCCGCGGATCAGCCGGTGACCAGCCCTGACGCCATGTCG
      > A W A L V A R R R L S D D P P R I S R .
52740 GCGACATTGGGGGTCGGGGTGGGTGGGATACCGCTATTTGGCCGACATGAAGTCGATCAACAGGCAGTGTGATCGGCGGGG
52832 GTCGGTCGACGGCCAGGCGGGCGTCGACGGAGGCGGGGGGAAGCGGTAGCGTCGGCGACGTGCCGAACTGTCGATTTCACTCGACTCGTCGC
      > V P N S I S L R L V L A
52924 GTCGGCGAGCCCTGCCCGTCGCCAAGCTCCTCCACGCCCGGCATCGAACCCGACGTGTGGTCAGTGGGGTCGAGTCCCAGGTGACCA
      > S A S P A R R K L L H A A G I E P D V L V S G V D E S Q V T
53016 GCGAGCGAGCCGAGGATCGTGTGCCCGCCGTGGCCCGGCGCAGAAGGCGCAGCCGGTCGTGCGCCGTCGGCCGACGAGCGGACG
      > S E R A E D L C L E L A R L K A Q A V V G R L R P S A D E R T
53108 CTGGTGCTGCGGCTGCGACTCGGTGCTGCTCGCCTTCGACCGCGAGATTCTCGGCAAGCCGGCCGACGAGCGGGAGCGTACCCGGGGTTGGGAGCG
      > L V L G C D S V L A F D R E I L G K P A D E A D A T R R W E R
53200 GATGCGGGGGCGCAGCGGGCGCACTGCTACACCACCGGCACTGCCTATCGACGTCATCCACGAGGGCGCCGAGGCGGTCGCCTCGACCACCG
      > M R G R S G V L H T G H C L I D V I H E T R A E A V A S T T
53292 TGCGTTTCGCTGACATCAGCGACGAGGAGATTGCCGCGTACGTCGGCAGGCGGTGGTCGCCGGCGCGTTCACCATCGACGGA
      > V R F A D I S D E E I A A Y Y V A T G E P L A V A G A F T I D G
53384 ATGGGCGGGGCGTTCCTGGAGGGTGTCGACGGTGATCGGCGACCCCGGCACGGTGGTCGGCCTCCTCCTACCGTTGCTGCGCGGCTTCTCGGCGAGCT
      > M G G A F L E G V D G D P G T V V G L S L P L L R R L L G E L
53476 GGACCTGCGGATCATCGACCTGTGGACGAAGGTCGCGCCCGGAGGCCAGGCGGTCGAGGCGGTGGGTACGGTCCAGCCATGACGACGAAGT
      > D L R I I D L W T K V A P G G Q A V E A V G T V Q P .
                                                                    > M T T K
53567 CCCTGCCGCTGACCCCGAACTGCATGCGTACGTGGTGCCCAGCGGAGTCGGACGAGGTGATGCGGGATCTGATCGAGGAGACCCTC
      > S L P L T P E L H A Y V V V A H G S D P D E V M R D L I E E T L
```

FIG.11A(46)

```
53659 GCCGCGGCTGCCCGCCGAGGCGAGGATGCAGGTGGCCCCGGAGCAAGCCGCGTTCCTCACCGGTTCCTGACGTTCCTGACGGGCGCGGGC
      >A A L P A E A R M Q V A P E Q A A F L T F L T R L I G A R R A
53751 GGTGAGGTGGGCACCTTCACCGGCCTGTCTCCCTGGCGCGGGCGGTTGACCTGCTTCGACATCTCGG
      >V E V G T F T G L S S L A I A R G L A E G G R L T C F D I S
53843 AGGAGTACACGGGCGTCGCGCGGCGGTACTGGGCGGTGGCCGACCAGATCGACCTGCGGTACGGACCCGGGGACACGCTG
      >E E Y T G V A R R Y W A R A G V A D Q I D L R Y G P A G D T L
53935 CGCGGGTTGCCGTACGAACGGCACCTGGACTTCGCGTTCATCGACGCGGACAAGGTCGGGGACGCGGGGAGTTGGTGCCCG
      >R G L P Y E R H L D F A F I D A D K V G Y P V Y W A E L V P R
54027 CATGCTCCCGGGCGGGGTCATCGCGGTGGACAACGTTCTGCGCGGGGGCCGGGTGCTCGCCGACGCGGCCATCGCCG
      >M L P G G V I A V D N T L R G G R V L A P R D A D D R A I A
54119 CGTTCAACGACGAGGTGATGGCCGACGTCCGACGTCCGGCCTGCTGCCGGTCGATCGCCGACGGGCTGACCCTGGCGCGGTGCGCTGACG
      >A F N D E V M A D V R V E P V L L P I A D G L T L A R V R .
54210 GGGCCAGCCGGACGATCGTGCCAGTCTCGCGCTGCCCGGCGTTCTGTGTCCCCTCAACCTCACACCTTAACAAGGGGCCCCTTGCGTTGCCAGAGGTCGCGGAGGTTGCGGGGTGTT
                                                           < · R V S R A F Q R A
54302 AGGAAGGGGGCCCTTCACCTTCCTATACCGAATGCGTTAACAAGGGGCCCCTTGCGTTGCCAGAGGTCGCGGAGGTTGCGGGGTGTT
      < · R V S R A F Q R A
54393 GCCCAGGCGACGCCGACGCGCAAGCCACCGCGATGATGGTCAGGCCCTGCCAGACCTTGTCGTTGCCGAGGTCGCGGCGAAGAGGGCCCG
      <A W A V G V A A L V A I I T L G Q W V K D N G L D G A F L A R
54485 GGTGCCGTCACGGCCCAGGAGAACGGGTTCCACTCGGCCGATGCGCTGGAGCGCTGGAACTGGAGCGCAGGATGCCGGAGA
      <T G D V A W S F P N W E A I R Q L W G P A F T L P L L I G S L
54577 GCAGCAGCAGGGCTGGGCGTCATCACCGAGCGTCTTGACCTTGAGCGCCGTCACGCCGTACGAGAGCGGCCGAG
      <L L V P Q A V T N M V P A L A D E S K V K L A V G Y S V A S
54669 GTCATCAGCGCGATCAGGCGACGAGCATCAGGTACGCCGATGAACACGCCAGTCGCCGAACGCGCCAGCTCGAACAGGAGCGCGAGCAGGGTGAT
      <T M L A I L A L M L Y A L L L D G I F V R L E F L L A L L T I
54761 GATGACGGCCTGGGCGACGCAGCAGCGGAGACGAGCTCGCGCAGGCCCGGCGAGCAGCAGCGGCGAGCGAGCTGACCGGGACCGTT
      <I V A Q A L L S V V D R L A R G L L A L R S V P T V R S R E
```

FIG.11A(47)

```
54853 CGATGAGCGGCGGCGCAGCTCGGCGATCAGGCCGAAGTCAGGCCCTGGAAGAGGCCCGAAGATGGCCAGCAGCACCAGCCGGCCACGAAG
      < I V G A R L E A I L G F G Q F L G G F I A L L V L L G P V F
54945 ATCTTGTACGCCTCGGCCTGGGTCGGCGTTCAGCGCCTTGAGCGGGGCGAAGAGGAGCAGGTACATCACGGCTGGAAGACGCC
      <I K Y A E A Q T P A N L A P K L L P A F L L L Y N V P Q F V G
55037 GACGAAGACCCAGACGGATTGCGGAGCAGGAGTTGCATCTGGCGCTGGGCGACGAGCAGGTGTCGCGGGCGAACTTCATGATCGGACT
      <V F V W V P N R L L Q M Q R Q A V L W T D R A F K M
55127 CCGGGTGGTCAGGACTCGCGAGCAGGCCGGTCTTGGTGAGGAAGACGTCGTCGAGGCTGGGGCGGTGCAGCTCGAGCTGAGCC
      < • S E R L S R G T K T L F V D D L S P R H L E I S S L R
55218 TGAGGCCGGACTGGTCGAGCCGGCAGGACCTGCGGCGCAGGATGGCGGTCAGGGCCAGGCCCGTCAGGGCCGGGTT
      < L G S Q D L R R L V Q P I A T A G E D V T L R L G G D V T
55310 TCCAGCTTGGTGACGTACGGCTCGGTGTCGAGCAGTTGGGCGGCCGGGATGGGCGCGGTCAGCGACGAGCAGCACCTCGCCGGA
      <E L K T V Y P E T D L L Q A A Q P T A A A D L G V L L E G S
55402 GATCTCCCGCTTCAGCCCGCCCGGCGTACCCTCGGCGACCACCTCGCCGTGGTCCATGCCGATCTCGTCCACATGTGGGCGCGACTCTGCGGGTCGAGG
      <I E R K L G G P T G E A V V E G H D M I A I R D C L A D A E D
55494 CCAGGTAGTGCGTGGTGATGAAGACGGTCATCCCGGCGCAGCCGGATCTCGGGATGCCGGAGTAGGT
      < L Y H T T I F V T M G E A R L R R I E D W M H A R S Q P D L
55586 CCGCTGGTCTCGTCCAGGAAGACAATGCGGAAGGTCGTGGTGCGGAGCTGGCCGCGGAGTAGGT
      <G S T P E D L F V I R P D H I I G L A I E V R R R Q G G S Y T
55678 CTTGCACTTACGGTCGGCGTACTCGGGTTGAGCTGGAAGGCCAGTGGCTGCCGGTGCGGAGGCGTCGGCCTTGCCGATGCCGTACA
      <K C K R D A Y E T L Q F A A L A R E A R R L A D A K G I G Y M
55770 TCCGGGTGTGCAGGACGGTTCCTGCGGCCAGTTCCTCCAGGTGCTGCCCTGGGCGACATAGCCGGATCGGCCGACGACGACCTCG
      < R A H L V L E E R A T S D D W T S G G Q A V Y G I R R R V E
55862 GCCGGGTTCCGCAGCAGGTCGGCCCCGGCGATGTGCCTGGCCTGCCGCGTCGGGGGTGATGAGGGTGGCCAGCATCCGCAGGGTGGTGGTCTT
      <A P N R L L D A G A I T A Q G G D P T I L T A L M R L T T T K
```

FIG.11A(48)

```
55954  CCCGGCGCCGTTGGGGCCGAGGAACCCGAAGATCTCCCCCTGGGCGACGTCCAGGTCGACGCCGCGCACGGGCGTCGACGCGTCTTGTGCTGTC
       < G  A  G  N  P  G  L  F  G  F  I  E  G  E  A  V  D  L  D  V  G  R  V  A  D  V  T  K  H  Q  R
56046  GACCGGCGCGGGAGCGAAACGACTTCCGCAGCCCTCTGGTCTGGATCATCTTCGCTCCTTAGCCGGACCGGGCCGGCCCTC
       < G  A  R  S  R  F  S  K  R  L  G  R  T  Q  I  M
56136  TCTCGGGGACAGCCACGGGTGGCCCCGAGGGTGCGCGCCAACGTCGCCGCGATATAACTCTAGTCAACTTTGATTAATGGCGA
                      < •  R  S  I  V  E  R  T  L  K  S  •  H  R
56227  CCGTCGGCCCTCCCCACGTTCCAGGTCCTGACGTCCTGATCGGCCAGATACGGCACGCCCTCGGGCAGCCTCGGGATCCGGTCGGCGACCCG
       < G  D  A  G  E  G  V  N  W  G  D  Q  S  A  L  G  E  P  L  Y  P  V  G  A  E  I  R  D  A  V  R
56319  CTCACACCAGGCCACCTGAGCTCTCCCGGCAATCTCCAGTCGTACATCCAGAGCTCGTATCCAGCGCTTGGAGTCGCGGATCCAGGAGG
       < E  C  W  A  V  E  V  E  G  R  A  I  W  L  E  Y  M  W  S  V  G  V  P  K  S  D  R  I  W  S  S
56411  ACTCCATCGAGGCACGCATGGTTTGACACTGGCCGCGCAGCCGCCACCTGCGCAGGCCTGGGCAGGCC
       < E  M  S  A  R  M  T  E  V  S  A  R  L  V  Q  G  R  S  R  L  A  A  V  A  E  P  R  P  L  A
56503  GGCAGGAACGCGAACCGGCGAACGGATCGTCGTCTGATGATTGCCCACCAGGCCGTCTCGAACTCGTCGACCCC
       < P  L  F  A  F  A  A  V  F  P  D  S  T  Q  H  N  G  W  M  L  G  R  L  L  T  E  F  E  D  V  G
56595  CTTCGGGGTGATCTCGTACGTCGTCTCCGCGCCGGGCTGCAGCCCTGCACCCCAACTGAGCAGCTCGCGGCGGACGCTGCGGTGCACC
       < K  P  T  I  E  Y  T  T  R  A  R  R  A  G  V  Q  E  T  A  V  E  R  L  L  G  E  E  G  L  K  R
56687  GCAGGCGCGTGGTAGATCGAGATCCGGGCTGCACGTTGGCCACCTTGTCGGCACACCCAACTTGTCGGCACGCCAAGTATTAGACAAGTTTGACTATCCAAGCATCTG
       < L  A  H  Y  I  S  G  P  Q  V  N  A  W  K  D  A  G  W  S  L  L  E  R  R  V  D  Y  G  H  V
56779  GGCTGCATCCACTTGACCAGGCCGAGAATCATGCGAGTGCCAGACACCGGGAAAAGAGTATTAGACAAGTTTGACTATCCAAGCATCTG
       < P  Q  M  W  K  V  L  G  L  I  M  M
56870  GGCAGTGCCTCATCCCACACTGAGCGTTAGGGCGGCGATCGTTAGGGCGGCGATAAACTCCCGTCAGTAACATCCCGGGAGGAGCCACGAG
56961  GTGCGCAAGTACTCATCGCCAAGCCGAGGCGAGATCGCCGTCGCCGTCATCCGGCCTGCGGACGCCTGGGCAGCGTCGCCGTCT
       > V  R  K  V  L  I  A  N  R  G  E  I  A  V  R  V  I  R  A  C  R  D  A  G  L  G  S  V  A  V
57052  ACGCGGACTCCGACGGGACGCCCTGCCGGGCCTGCCCGACCTGCACGGCGTACGCCCCGAGGGCGGCGACACCGCCGCCGAGACGTACCTGCGCGG
       > Y  A  D  S  D  R  D  A  L  H  A  T  L  A  D  E  A  Y  A  L  G  G  D  T  A  A  E  T  Y  L  R
```

FIG.11A(49)

```
57144 ATCGACAAGCTGATCGCCGTCGCGGGCACAAGGCCGGGGCCGACGCCGTCCACCCCGGGTACGGCTTCCTCGCCGAGAACGCGACTTCGCCCA
      > I  D  K  L  I  A  V  A  A  Q  A  G  A  D  A  V  H  P  C  Y  G  F  L  A  E  N  A  D  F  A  Q

57236 GGCCGTCCTCGACGCCGGGCTTACCTGGCCCGACCCCACAGGCCGATCGGCGACCTGGGCGACAAGGTCACGCGCCACATCGCCG
      > A  V  L  D  A  G  L  T  W  I  G  P  T  P  Q  A  I  R  D  L  G  D  K  V  T  A  R  H  I  A

57328 AGCGGGCCGGGCGCGCCCCTGGTTCCCGGTACCTCGGACCCGGTCGGCAGCCCGGACGAGGTGATCGCATTCGCGGTCGACCACGGCCTGCCG
      > Q  R  A  G  A  P  L  V  P  G  T  S  D  P  V  G  S  P  D  E  V  I  A  F  A  V  D  H  G  L  P

57420 GTCGCCATCAAGGCCGCCTTCGGCGGCGGCCGGGGCCTCAAGGTGGCCCGCACGATGGAGGAGATCCCGCACCTGTTCGAGTCGGCCAC
      > V  A  I  K  A  A  F  G  G  G  R  G  L  K  V  A  R  T  M  E  E  I  P  H  L  F  E  S  A  T

57512 CCGGGAGGCGGTCGCGGCGTTCGGCCGGGAGTGTTTCGTCGAGCGGTACCTCGACCAGCCGCGTCACGTCGAGGCCCAGGTCCTCGCCG
      > R  E  A  V  A  A  F  G  R  E  C  F  V  E  R  Y  L  D  Q  P  R  H  V  E  A  Q  V  L  A

57604 ACCAGCACGGCAACGTGATCGTCGTCGGCACCCGGGACTGCTCGCTCCAACGCCGGCACCAGAAACTCGTCGAGGAGGCCCCGCCGTTC
      > D  Q  H  G  N  V  I  V  V  G  T  R  D  C  S  L  Q  R  R  H  Q  K  L  V  E  E  A  P  P  F

57696 CTCACCGACGCCCAGCGCCGGCAGATCCACGACAGCGCCAAGGCAATCTGCCGGGAGGCCGGCTACCACGGCGCGGCCGTGGAGTACCT
      > L  T  D  A  Q  R  R  Q  I  H  D  S  A  K  A  I  C  R  E  A  G  Y  H  G  A  G  T  V  E  Y  L

57788 GGTGGGCACGGACGGGACAGTTCCGGATCGCCAGCGGCGAAGCTGCCGGAGAAGCTGCGGGCACTCCATCGAGTTCCGGATC
      > V  G  T  D  G  T  I  S  F  L  E  V  N  T  R  L  Q  V  E  H  P  V  T  E  E  T  A  G  I  D

57880 TCGTCCGCGAGCAGTTCCGGATCGCCGACGGGGAGAAGCTGCGCCTCGCCGAGGATCCGCCCACCCCGCGTGCCGGGTGCCGGGTGGACAC
      > L  V  R  E  Q  F  R  I  A  D  G  E  K  L  R  L  A  E  D  P  P  T  P  R  G  H  S  I  E  F  R  I

57972 AACGGCGAGGATCCCGGGCGCAACTTCGACTCCGCGGCCAAGGTGATCATCACGGGCGAGACCCGCACCGAGGCCCTGG
      > N  G  E  D  P  G  R  N  F  L  P  A  P  G  T  V  T  A  L  R  L  P  T  G  P  G  V  R  V  D  T

58064 CGGCATCTCCGCCGGCGACGTGATCGGCGGCAACTTCGACTCCCTGCTGGCCAAGGTGATCATCACGGGCGAGACCCGCACCGAGGCCCTGG
      > G  I  S  A  G  D  V  I  G  G  N  F  D  S  L  L  A  K  V  I  I  T  G  E  T  R  T  E  A  L

58156 AGCGGGCCCGGCGCGCGCTGGACGAGATGGTCGTCGAGGAATGGCCACGGCGCTGCCGTTCCACCGCCTGGTGGTACGCGGACCCCGCGTTC
      > E  R  R  A  R  A  L  D  E  M  V  V  E  G  M  A  T  A  L  P  F  H  R  L  V  V  R  D  P  A  F
```

FIG. 11A(50)

```
58248 ACCGCCGCCGCCGTTCACCGTGCACACCCGGTGGATCGAGAGGAGTTCGACAACACCGTCCTGCCGTTCACCGCCGCCGCGGCCCCGCCGA
      > T  A  A  P  F  T  V  H  T  R  W  I  E  T  E  F  D  N  T  V  L  P  F  T  A  A  A  G  P  A  E

58340 GGGCCCGGCCGAGCGGGAGACCGTCGTGGTCGAGGTCGGCGGCAAGCCGGCTGGAGGTGACCCTCCCCGCCGGCCTCGGCGCGGGTACGGCCG
      > G  P  A  E  R  E  T  V  V  V  E  V  G  G  K  R  L  E  V  T  L  P  A  G  L  G  A  G  T  A

58432 CCGGGCCCCGCGCGGGAAGCCGGCCGGGCGGCGGGGCGGCAAGGCCGGCCAAGGCGGCGACGCCCTCACCTCTCCGATGCAG
      > A  G  P  A  A  R  K  P  A  R  R  G  G  G  A  K  A  G  A  A  V  G  G  D  A  L  T  S  P  M  Q

58524 GGCACGACGATCGTGAAGATCGCCGTCGCCGACGGGGACACCGTCGCGCCAAGGGCGACCTGGTCGTCGTGGAGGCGATGAAGATGGAGCAGCC
      > G  T  I  V  K  I  A  V  A  D  G  D  T  V  A  K  G  D  L  V  V  V  L  E  A  M  K  M  E  Q  P

58616 GCTGCACGCGCACAAGGCGGGCACGGTCGGCGGGGCTGTCGCGGCCGAGGTCGGCGCGGTCGCGGCCGAGGTCGGCGCCGTCCTCGCCGCCATCTGCACCATCACCT
      > L  H  A  H  K  A  G  T  V  G  G  L  S  A  E  V  G  A  V  L  A  A  G  A  P  I  C  T  I  T

58708 GAGGTGCAAGGAGGGGCCCCTTGTTAACGCATTCGGTATAGGAGGCGGAGCCCGGGGTGAGGACCGGGACCGGGCCGCCCCAGCCCGGG
      > L  H  A  H  K  A  G  T  V  G  G  L  S  A  E  V  G  A  V  L  A  A  G  A  P  I  C  T  I  T
      >.

58800 TACGCGTACCGGCCCGGGGTGTTTCCGGACCTGACCTACAACGACGTCTTCATGGCCGCCAATGATGCCAGGTCGCGTTCCTACATGGC
      >               > V  R  F  L  H  G

58891 GCGGTTCCCGCCGCACGACCTGACCTACAACGACGTCTTCATGGCCGCCAACCGCTCCGAGGTCGGCGTTCCGAGGTCGCTCCGACGTTGGACGCTGGCCAC
      > A  V  P  A  H  D  L  T  Y  N  D  V  F  M  A  P  N  R  S  E  V  G  S  R  L  D  V  C  L  A  T

58983 CTCCGACGCGACGGGCACCACCATCCCGCTGGTGGTGGCGAACATGACGGCGGTGGCCGGCGGGATGCGGCGGATGGCCGAGACTGTCGCCCGGCGGG
      > S  D  G  T  G  T  T  I  P  L  V  V  A  N  M  T  A  V  A  G  R  R  M  A  E  T  V  A  R  R

59075 GCGCACTCGCGGTAGCCGTGATCCCGCAGGACGACATCCCGAGGTGGTGGCCAACGGTCGCCTGGGTCAAGCAACGGCACCTGGTCGACGACACG
      > G  A  L  A  V  I  P  Q  D  D  I  P  I  E  V  V  A  N  V  V  A  W  V  K  Q  R  H  L  V  H  D  T

59167 GCGATCACGCTCGGCCCGACGGACACCGTCGGGGGTGACGGCGGAGGGCGGACACCGTCGGGGTGACGGCGGTGGTGGTGGTCGACGAGGC
      > A  I  T  L  G  P  T  D  T  V  G  D  A  I  H  L  L  P  K  R  S  H  G  A  V  V  V  D  E  A

59259 CGGTCGGCGCGCTGGGGCGTGGTGACGAGGCGGGACACCGTCGGGGTGACGGCGGTGGTGGTGGTCGAGCAGTTGCACA
      > G  R  P  L  G  V  V  T  E  A  D  T  V  G  V  D  R  F  A  W  L  R  H  V  M  S  T  E  L  H
```

FIG.11A(51)

```
59351 CGGTGCCGGCGGACGCGGAGACCGCGTACGGGATTCGACCGGCTCTCGGCGGGCCGGCGGGCTCGCGCCGGTGGTGGACGGGCGACGGCCGG
     >T  V  P  A  D  A  D  P  R  T  G  F  D  R  L  S  A  G  R  R  R  L  A  P  V  V  D  G  D  G  R
59443 CTCGTCGGGGTGTTGACCCGCAAGGGCGCGCTGCGCGACGTCACCCGCGACCCTCTACACCCCGCGCCTGAGGGCCGGCTGCGGATCGCGGCGGC
     >L  V  G  V  L  T  R  K  G  A  L  R  A  T  L  Y  T  P  A  V  D  D  R  G  R  L  R  I  A  A  A
59535 CGTCGGGCATCAACGGCGACGTCACCGGCAAGGCCGCGCTGCTGGAGGGCGTCGACGCCCTGGTCGTGGACACGGCCCACGGCCACC
     >V  G  I  N  G  D  V  T  G  K  A  A  L  L  E  A  G  V  D  A  L  V  V  D  T  A  H  G  H
59627 AGGGCGCGGATGGTCGCGCTGCGCGCCGTGCGCAAGCTTCACCCGGGCGTTCCGGTCGCCGCAACGTGGTCACCGCCGATGGGGTA
     >Q  A  R  M  V  A  A  L  R  A  V  R  K  L  H  P  G  V  P  V  A  A  G  N  V  V  T  A  D  G  V
59719 CGGCGACCTCGTCGAGGCCGGCGACATCGTGAAGGTGGGCGTCGGGCCGGGAGCGATGTGCACCACCCGGATGATGACCGGGGTGGGGCG
     >R  D  L  V  E  A  G  A  D  I  V  K  V  G  V  G  P  G  A  M  C  T  T  R  M  M  T  G  V  G  R
59811 TCCGCAGTTCTCCGCGGTGCTGGACTGCGCGCGCGGCGGCGGCGTACGGCACCGCGCG
     >P  Q  F  S  A  V  L  D  C  A  A  A  A  R  D  L  G  R  H  V  W  A  D  G  G  V  R  H  P  R
59903 ACGTGGCGCTGGCCCTCGCGCCGCCGGCGTCGAACGTGATGATCGGTTCCTGGTTCGCCGGCACGTACGAGTCCCCGGGTGACCTGTACACG
     >D  V  A  L  A  L  A  A  G  A  S  N  V  M  I  G  S  W  F  A  G  T  Y  E  S  P  G  D  L  Y  T
59995 GACGCGGACGGCCGGAGGTACAAGGAGAGCTTCGGCATGGCCTCGTCGCGCGCGGTCAGCGCGCGCACGGCCGAGGACAGCGCGTTCGACCG
     >D  A  D  G  R  R  Y  K  E  S  F  G  M  A  S  S  R  A  V  S  A  R  T  A  E  D  S  A  F  D  R
60087 GGCCCGCAAGGGGATCTTCGAGGAGGGCATCTCCTCGGCCCGGATGTACCTCGACCCCGACCGGCCCGGCGTCGAGGACCTGATCGACGAGA
     >A  R  K  G  I  F  E  E  G  I  S  S  A  R  M  Y  L  D  P  D  R  P  G  V  E  D  L  I  D  E
60179 TCATCTCCGGGGTACGCAGCGCGTGCACGTACGCGGGCGCGCGCAGCCTGGCCGAGTTCGCGGAGCGGGCGCTGGTCGGGGTGCAGAGCACG
     >I  I  S  G  V  R  S  A  C  T  Y  A  G  A  R  S  L  A  E  F  A  E  R  A  L  V  G  V  Q  S  T
60271 GCCGGCTACACCGAGGGGATGCCCCTACCGACGAGTTGGTGACCGACTGCCGCGCCGGCGGTGAGAAGGGTTCCCCTCTCTACGGAGGCGTCAA
     >A  G  Y  T  E  G  M  P  L  P  T  S  W  •
60362 CAAGGGGCCCTTCGTCGCGAGGCGTGACCGACTGCCGCGCCGCCGCGCACTGAGCCGCCCGTCGAGGGCCC
```

FIG. 11A(52)

```
60454 ACCGAACGGGCGCGGGGTCAGTGCGAAGAGGGCGACGGATGACGGTCCGGGCCGGGCGGGCCTCCGGGTCCGGGCCGGTGCCGGGCGGGGAGCGCC
        <  •   D  F  L  R  R  I  V  T  R  A  A  A  E  P  D  P  G  T  G  P  P  L  A

60545 CCGGCCAGCCAGAGTGTCACGAAGCCGTGCACGATCGACCAGGCGGCCAGGGCGGTCCGCCTCCTGGTCCGGGTCGGTTTCCCGGCGCGGGAG
        <  G  A  L  W  L  T  V  F  G  H  V  I  S  W  A  A  L  A  D  A  E  Q  D  P  D  T  E  R  R  P  L

60637 GGCGGCCACCCCGGCCGCCGGCCAGCCCGATCACGGGCGGTCTGTCACCTCGGGGTCGTCGCGACGGTAGAGCTCCGGGACGGAACA
        <  A  A  V  G  A  R  L  A  A  G  A  R  D  R  A  A  T  V  E  P  D  D  R  R  Y  L  E  P  R  F  M

60729 TCACCTCGAAGTGGGCCCGGTCGACGCGCAACCGATACGCCACGCGGGCTGCGAGCAGGTCGCCGGCCTCGCACAGCGCCCGGCC
        <  V  E  F  H  A  R  H  D  V  A  F  R  V  Y  A  V  G  A  D  L  L  L  D  G  A  E  C  L  A  G  A

60821 AGCAGGTCGAATCCCTGACGGCGAGCGCGGTGAGCAGCCCGCCTTGTCGCCGAAGTGGTGCGCGGGGGCGGCGTGGCAGACCCGGCCG
        <  L  D  F  G  E  V  A  L  A  T  L  L  G  A  K  D  G  F  H  H  A  P  A  A  H  S  V  G  A  R

60913 GCGGGCCAGGTCGCGCAGGCTCAGGGCCCGGCCCGGCGTCGGTGATCGCGTCGACGGCGAGCAGGGCGCGACGCAGGTCACCGT
        <  R  A  L  D  R  L  S  L  A  A  P  G  A  D  T  I  A  D  V  A  A  L  L  A  R  R  L  D  G  H

61005 GATGGTAGCCACGCGGTCCGGTCATGCCGGCCAGCCTAACTTGTCATTGACAAGATAGCCAAGGCCGAAGCAATCTAGGCAAGTTG
        <  H  Y  G  R  P  G  T  M

61095 CCTTCGACCGAGGAGAACCCCGGCCTGGGCCGGCCTCGGCCCTGGCCGGCTCGGCCTCCATCGCTCTCATCGCGGGCTACTCAACGTCGACG
                                                 >  M  V  P  P  R  L  P  H  P  G  L  L  V  T  G  L  L  E  L  A  G  A  V  A  L  L

61187 CCCTGGCCGCTGGCACCCCGCCCGCCCTGCGCACCGCCATGTTCGCGCTCACCGGGATCGCCCACTTCACCTCCCGACGGCCCGAC
                                    >  V  P  G  T  A  R  W  A  A  A  G  L  G  L  L  L  L  A  M  F  P  A  N  A  S  A  A  R  R  G

61279 CTGGTCGCGCCATGGTGCCGCCCCGACTGCGCCCCGACTGCCGCCGGGCCTGGTGACGTGCTGCTGCGGCTCTGGAGTTGGCCGCGCGGTCGCGCTGCT
                                    >  L  T  L  A  G  R  P  V  T  P  L  V  P  R  A  L  L  Q  V  I  F  L  T  A  A  A  I  S  F  G

61371 CGTCCCCGACAGGCGCACGGCGGTGGGCAGCGCGGCGGCCGGGCTCCGGCCAACGCCTCGGCGCCTCGGGCGCCCCGGCGCGGGGC

61463 TGACCCTGGCCGCCGACCTGGCCGTCGTTAACATGACCGCATGAGGGAGCTGATGAGCTGATGAGCTGAGGAGCGCCACTGCCACTCGGCCGGCGATTTCGTTTGGG
        >  L  T  L  A  G  R  P  V  T  P  L  V  P  R  A  L  L  Q  V  I  F  L  T  A  A  A  I  S  F  G

61555 CCCTGACTATCAGGGAGCTAACATGACCGCTGATGAGCTGATGAGCTGAGGAGCGCCACTGCCGCCACTCGGCCGGCTGCTGGTGACCGCCGGCCA
        >  P  •
```

FIG.11A(53)

```
61645 CGTCGTCGGCAACGGTGGAACCGCTACCTCGCCGAGGAGCACGGGCTCACCCTGATGACCCTGGCCGGCACG
      > V V G Q R W N R Y L A E E H G L T Q A G M V T L M T L A R H
61737 GCGAGCTGCCGCACCGGGCGGTCGCCGAGGCGTGCTTCATCCGGCCACCCTAACCGGCATCGTCGACACTGGAGCGGCGACGGCCTC
      >G E L P H R A V A E A C F I R P A T L T G I V D T L E R D G L
61829 GTCGAGCGGCAACGCGACGACGTCGATGACCTCGGTGCGCAGCGTGCGGCTCGTCGTTGCGGTCCTCGACCCCGCCGTCGGGAACGGTGCGCCGCTCACCAACGT
      >V E R Q R D D V D R R S V R L V L T P A G R E R V A A L T N V
61921 CATGCAGTCGGACGACCGATGACCTCGGTGACGCCGAAGGCCGTGATCGGCCAGTTCCTGCTCGAGGTCATCGGCAGTG
      > M Q S G R P M T S V D A D P A K A A V I R Q F L L E V I G S
62013 GAGAGGAACCTCGGGTGACGGCCCTCGACGCGGAGGCCGGAGCCTCCGGCGCTGCTCCGGCGCCCACCTGCCCGTACCGTC
      >G E E P R V T A L D A R P E A P A C .
62105 GACCGCTGGCGCGGTGATGGCGTTGCAGTTCGTCGTACGGCTACCTGCCGAGCCTCAACGCCGACATCATCGACCAGGG
      >M A L Q F V G T M A S L Y L P S L N A D I I D Q G
62196 TGTGGCCCGGGGCGACACCGGCTACATCATGCGGACCGGGCGGCTGCTGGTGCAGATGCCCGCCCACCGCCTGCTCCACCGCGCGGG
      > V A R G D T G Y I M R T G G W M L L V S L V Q I A C S T A A
62288 TCTTCCTCGGCGCGCGGAGCGCTTCGCGCGGGACGTTCGCCGCGGGACGTGCGCGGCAAGGTGCAGCCGGTTCTCGCCGCCGGAGGTG
      >V F L G A R S A M G F G R D V R A E V F A H V N R F S A R E V
62380 ACCCGCTTCGGCGCCTTCCTGCTCATCACCGGCGATCATGAGCGTGTTCATGGCACTGCTTCCTGGCTGTCGTCCTGATGAGCTGCACCATGCTGGT
      >T R F G A P S L I T R N T N D V Q Q V Q M L V L M S C T M L V
62472 CGCCGCGCGGATCATGAGCGTCGGCGGGGTGTTCATGGCACTGCGGGAGGATGTTCCGGGTTCCGGGCTGCATCGAGACCGGTCAACGCGGTCGTCGCGGC
      >A A P I M S V G G V F M A L R E D V G L S W L M L V S V P A
62564 TGGCGCTGATGCTGATCATCCGGCGGATGGTGCCGGGATGGTGCCGGGTTCCGGATGCTGCAGACCGAGACGGCGTACGAGCGGCGTCAACGCGGTGCGGCGGC
      >L A I A L M L I I R R M V P G F R L M Q T R I D A V N R V L R
62656 GAGCAGATCACCGGCATCCGGGTGGTCCGGGCGTTCGTCCGCAGCCGGCTTCGTCCGCGAGCCGTACGAGACGGCGCGCTTCGGCCGGGAACGCCAACGACCTCACCGC
      >E Q I T G I R V V R A F V R E P Y E T A R F G R A N A D L T A
```

FIG.11A(54)

```
62748 GACCGCCCTGCGCACCGGTCGGTTGATGGCCCTGATCTTCCCCGTGGTCGCTGGTGACGCTGGTGCTGAACGTCTCCAGCGTGCCGTCGTGGTTCG
     > T A L R T G R L M A L I F P V V T L V L N V S S V A V L W F
62840 GCGCGGACCGCGTCGACGCCGGCCAGATCCAGGTCGGCGGCGTCGGCACCGCCTTCCTGCAGTACCTCATGCAGATCCTGATGGCCGTCATGTTG
     > G A D R V D A G Q I Q V G A L T A F L Q Y L M Q I L M A V M L
62932 GCCACCTTCATCCTGATGATGGTCCCGCGCGCGGTCTGCGCCGAGCGGATCGTCGAGGTGCTCGACACCGACTCGACGGTGATCCCGCC
     > A T F I L M M V P R A A V C A E R I V E V L D T D S T V I P P
63024 GGCCGGCGCGACGGCCGAGGTGACCGGCCGGGAGCTGGAACTGCGCGGCGTCCGGTTCCAGTACCCGGGGGCGAGCGCGCCGGTGCTGC
     > A A P T A E V T G R G E L E L R G V R F Q Y P G A S A P V L
63116 ACGACATCTCGTTCCGGGCCACGCCCGGGCGCACCACCGCCATCATCGGCAGCACCGGCGCCAAGACCACCCTGCTGACGCTGATCCCC
     > H D I S F R A T P G R T T A I I G S T G A K T T L L T L I P
63208 CGGCTGATCGACGCCGGCGCCGTGCTGGTCGACGGCGTGGACGTGCGTGACCTGGCCCCGGACGATTTGTGGCGGGATCGGGCT
     > R L I D A G A V L V D G V D V R D L A P D D L W R R I G L
63300 GGTGCCGCAGGGCCGCTACCTGTTCAGCGGCACGATCGCCAGCAACCTGCGCTACGGCAACCCGGATGCGGAGCTGTGGGCCG
     > V P Q R P Y L F S G T I A S N L R Y G N P D A T D A E L W A
63392 CCCTGGAGATCGCCCAGCGCGACTTCGTCGCCGAGTTGCCCGAAGGGCTGAACGCCCGATCACGCAGGGCGGCACCAATATCTCCGGC
     > A L E I A Q A R D F V A E L P E G L N A P I T Q G G T N I S G
63484 GGGCAGCGCCAGCGCCTGGCCGATCGCGCCCTGGTCCGCAAGCCGGAGATCTACCTGTTCGACGACTCGTTCTCGGCGCTCGACCTGGG
     > G Q R Q R L A I A R A L V R K P E I Y L F D D S F S A L D L G
63576 CACCGACGCCCGGCTGCGGCGCCTGCGCGCGGCGCTACGACGGGCATCGTCGCCCAGCGGGTCTCCACGATCGTCGACG
     > T D A R L R A A L R P V T A D A T V L I V A Q R V S T I V D
63668 CCGACCAGATCATCGTGCTTGAGGACGGGGCATCGTCGGGATGGGCGGCGTACGACGTACGCGGAGATC
     > A D Q I I V L E D G G I V G M G R H A E L L E D C P T Y A E I
63760 GTCGCCTCCCAGCAGACAGCGGGTGCCGGCGTACCGATCAGCGGCCGATCAGCGCGGCGGCGAGGGCCGACGCCGAA
     > V A S Q Q T A G V P A  .
```

FIG. 11A(55)

```
63851 GCGGCTGCCCTCCGGCAACCAGGGCAGGCCCGAGGTGGATGAGCGCCGGCATGCCGGCCGAGAAGTCGATGAACTTCGGGCCGTCCAC
             > M  S  A  G  M  P  A  E  K  S  M  N  F  G  P  S  T

63941 CCGCGGCTGCTGCGCCGGCTGCGACCGCACGCCTCCAGTGCCGCCATCGTCCTGCTCTCGCTTCTCGTTGCAACGTGTACG
      > R  R  L  L  R  R  L  R  P  H  R  L  Q  L  A  A  I  V  L  L  S  L  L  V  S  V  G  C  N  V  Y

64033 GGCCGAAGGTGCTCGGCCACGCCACCGACCTGATCTTCAGCGGGGTGATCGGCCGGCAGTTGCCGGCCACCGCCGAGCAGGCGGTC
      > G  P  K  V  L  G  H  A  T  D  L  I  F  S  G  V  I  G  R  Q  L  P  A  G  T  T  A  E  Q  A  V

64125 GCGGCGGCCGCGCGGGCCGGTAACGACAGCTTCGCCGACATGCTGGCCCGGATGGACGTGGTGCCCGGGGTGGGCATCGACTTCACCGCCCT
      > A  A  A  R  A  A  G  N  D  S  F  A  D  M  L  A  R  M  D  V  V  P  G  V  G  I  D  F  T  A  L

64217 GGGCCGGGTGCTGCTGTTCGTGCTGGCGCTCTACCTGGGCGTGGAAGGACAAGCTGAACCGGCTGCAGCTGTATTTCGACCGGCAGCCCCGGGGCGAGTTGCTC
      > G  R  V  L  L  F  V  L  A  L  Y  L  A  A  S  V  L  L  W  Q  G  W  L  L  N  G  V  V  Q

64309                                                                                                                               
      > R  T  V  L  R  L  R  A  D  V  E  D  K  L  N  R  L  Q  L  Q  Y  F  D  R  Q  P  R  G  E  L  L

64401 AGCCGGGTCACCAACGATGTTCGCGATCTCGCCGCTGTTGGCGCTGTTGGGCCAGTGCCATACCGGAGAGCTGAACGGCCAGATCGAGGAGCGTTCACCGGACACGAGCTGGTC
      > S  R  V  T  N  D  I  D  N  I  S  Q  S  L  Q  Q  T  L  S  L  V  A  V  P  M  S  V  V  T  S  L  V  A

64493 ACTGGCCATGATGTTCTGGATCTCGCCGCTGTTGGCGCTGGTGTCCCTGCTGGCGATCGAGGAACGGGGATCAATCCAGTTCATCTC
      > L  A  M  M  F  W  I  S  P  L  L  A  L  V  S  L  L  V  A  V  P  M  S  V  V  T  S  L  V  A

64585 AGCGGTCTTCGGCCAGCGCCGCGAGGTGGAGGCCGCCTTCACCGCCAAGAACGAGGAGCTGTTCCGGGCGCCAGTTCATCTC
      > K  R  S  Q  Q  R  F  I  A  Q  W  T  H  T  G  E  L  N  G  Q  I  E  E  A  F  T  G  H  E  L  V

64677 AAGGTCTTCGGCCAGCGCCAGGAGGTGGAGGCCGCCTTCACCGCCAAGAACGAGGAGCTGTTCCGGGCGCCAGTTCATCTC
      > K  V  F  G  R  Q  R  E  V  E  A  A  F  T  A  K  N  E  E  L  F  R  A  S  F  G  A  Q  F  I  S

64769 CGGGATCATCATGCCGGCCATGATGTTCATCGGGAACCTCAGCTACGTCGCGATCGCCGTGGTCGGCGGGGTGGGCCGTCGGGGTCGA
      > G  I  I  M  P  A  M  M  F  I  G  N  L  S  Y  V  A  I  A  V  V  G  G  L  R  V  A  S  G  S

64861 TGAGCATCGGCGACGTGCAGGCATTCATCCAGTACTCCCTGCAGTTCACCCAGCCGCTCACCCGCGTCGCCTCGATGGCCAACCTGCTCCAG
      > M  S  I  G  D  V  Q  A  F  I  Q  Y  S  L  Q  F  T  Q  P  L  T  R  V  A  S  M  A  N  L  L  Q
```

FIG.11A(56)

```
64953 TCCGGGGGTGGCCTCCGCCGAGCGGGTGTTCGCGGTGCTCGACGCCGAGGAGCAGAGCCCGGACCCGGCGGTGCCGGCCCGGGTCGCCGACCA
     >S  G  V  A  S  A  E  R  V  F  A  V  L  D  A  E  E  Q  S  P  D  P  A  V  P  A  R  V  A  D  Q
65045 GCGCGGTCGCGTCGAATTCGACCACGTCTCATTCCGGTACGCCAAGACCGGACAAGCCGACCTGTCGTCGCCGAGCCGGGC
     >R  G  R  V  E  F  D  H  V  S  F  R  Y  E  P  D  K  P  L  I  T  D  L  S  L  V  A  E  P  G
65137 ACACGGTTGCCATCGTCGGGCCGACATCACCACGCTGAGCGCCGACCTGGTCGTCTACGAGCTGGACGCCGGCCGGATC
     >H  T  V  A  I  V  G  P  T  G  A  G  K  T  T  L  V  N  L  V  M  R  F  Y  E  L  D  A  G  R  I
65229 ACCCTCGACGGGTCGACATCACCACGCTGAGCCGCGACGACCTGCGCGGCCGGATCGGCATGGTGCTCCAGGACACCTGGCTCTTCGGTGG
     >T  L  D  G  V  D  I  T  T  L  S  R  D  D  L  R  G  R  I  G  M  V  L  Q  D  T  E  L  F  G  G
65321 CACGATCCGCGACAACATCGCGTACGGCCGGCCGGACGCGAGCGAGGAGATCGTCGCCGCCGCCCGGGCGACGTTCGTTGACCGGTTCG
     >T  I  R  D  N  I  A  Y  G  R  P  D  A  S  E  E  E  I  V  A  A  A  R  A  T  F  V  D  R  F
65413 TGGGTAGCCTCCCCGACGGCACCGACACCGTCATCGACTCGAGGGCAGCAACGTCAGCGCCGGCGAGAAGCAGCTCATCACCATCGCCGG
     >V  R  S  L  P  D  G  T  D  T  V  I  D  S  E  G  S  N  V  S  A  G  E  K  Q  L  I  T  I  A  R
65505 GCGTTCCTGGCCGAGCCGTCGCTGCTGATCCTCGACGAGGACGCCAGTTCGGTGGACACCCGCACCGAGGTGCTGCTCCAACGGGCATGGC
     >A  F  L  A  E  P  S  L  L  I  L  D  E  A  T  S  S  V  D  T  R  T  E  V  L  L  Q  R  A  M  A
65597 GGCGCTGCGCTCGGACCGGACCAGCTTCGTCGTCATCGCCCACCGTTGTCCACCATCCGGCGGATGATCCTGATGGAGCACGGTC
     >A  L  R  S  D  R  T  S  F  V  I  A  H  R  L  S  T  I  R  D  A  D  L  I  L  M  E  H  G
65689 GCATCGTCGAGCAGGGCACCCACGAGCAGCTCCTGGCCGCGCGGGCTTTACCAGGGCGTCGACCCCGGGGCTGACCTCGTCGTCGACCCG
     >R  I  V  E  Q  G  T  H  E  Q  L  L  A  A  R  G  A  Y  H  R  L  Y  A  Q  A  F  T  Q  P  D  P
65781 GCGCAGCTCCCGGGGACCCCGAGCCCGCAGCCGGCGAGCGTGCGGGGCCAG
     >A  A  V  G  D  P  E  P  Q  P  A  S  V  R  G .
65872 GGGCAGCTCCCCGGGCGCGCCGGAAGACGCAGAGCGTGGTGGTGCGCGGGGAGCACGGCAGAACTCGTCGTCGGGCCCAGCCG
65964 CATCGGCGGGAACATGTCGTCGCGCGAAGTGGCCGAGGTCGGGGCCTCGATGACGGTGCGGGGGTTCCCCGACGTCG
66056 TGGTCCGTACGCGCTGCGCAGGCAGCATCGGCGCATCCGAATTCGGGCCGGCCCGACGCAGCCGAGACG
66148 CATCCGGTTACCGCGAAGGGCGACAGGCCGCAGTCGCTCGGCTGGCCTCGGGGCCCGGACCCGCTCGGGCGGCCGCCGGCAC
```

FIG.11A(57)

```
66240  GGGACCTGCCGGGGGGCCCATGGCGGGCCCGGTCGTCGGCTACGGGGGGTCCGACACTCGAGGCCGCGCCGACTACGCGGGCGCGTCGGC
66332  GATCGCGCGACCGCCTCCACCGTACGCCGAGGTTGCCGGCGTCCCAGCGGGTTCCCCCGCCGCCGCCGCCGCCGTCGCCGGCCC
66424  GACGACCCGGTTCGTGCGGGGTGCCGGCGGCGAGGTGGAGCCGCCGCCAGTTACTCCAGTCGTGGAGCATGAGCTGGCGGGCGGCCTCGGTGATC
                < .  E  L  E  H  L  M  L  Q  R  A  A  E  T  I
66515  GAGCCCGACAGGCTCGGGGTAGATGGTCTGGGCCAACTCGTTGACCGTGAGGTTGTTCTCCACCGCCATGGTGATCGGCAGGATCAG
         S  G  S  L  S  P  Y  I  T  I  T  Q  A  L  E  N  V  T  L  N  N  E  V  A  M  T  I  P  L  I  L
66607  CTCGCTGGCCTTCGGTGCCACCACCACGTTCGGCGATCCTGGCCGCGGCAGAACAGCTTCACGAAGCGTTCGGCGAGGTCGT
        < E  S  A  K  P  A  V  V  G  G  I  V  Q  G  S  A  P  R  C  G  L  K  V  F  G  D  A  L  D  D
66699  CCATCTTCCGGGCGTTGCCGACAGCGGCAGCAGTCTTGCCGGCGTCGGGGTCTTGCCGGCGTCACCTCGTCTTGGGAGACGCCGACG
        < M  K  A  R  A  N  G  S  L  P  L  M  V  Q  R  A  P  T  K  G  A  S  V  E  D  Q  S  V  G  V
66791  GTGGCCAACTCCGGTCGTGAAGACGTTCGCGCGCAGACGTTCTCGCCAGCCCGGAACGCGCTCGCCGAGCGCGTGCCACATCGCGAT
        < T  A  L  E  P  D  T  F  V  N  A  A  V  T  R  L  R  L  P  R  V  A  E  G  L  A  H  W  M  A  I
66883  CCCGGCCCTGCATGGCGGCGACGCTGGCCAGCGCTGCCGGCGCAACACCCCGGTGCAGCTGCAGTCGCCGGGACGTTGGTGCGGACACCG
        < R  G  Q  M  A  A  V  S  A  L  P  L  V  G  T  C  D  G  A  A  Y  I  G  P  V  N  T  R  S  V  R
66975  GGTCGACGCGTGAGCGTAGCGCGCCCCGGGACTCGACGCGTACTCGGGAGGCCGAGGTTGGGGATCGAGCCGACGCGATG
        < D  V  T  V  Y  G  G  R  A  L  E  V  G  T  E  A  L  G  L  N  A  T  N  P  I  S  G  V  A  I
67067  AGCGCGTGCGAGCGTGCACCAGCCGGTGCACCTCGACCTCCACCCGTCGGCAGTTCGACCTCTCCGGCGCGGAGTTGTT
        < L  A  H  S  G  H  V  L  R  G  D  A  L  E  V  E  V  G  D  A  I  R  Q  V  R  E  A  R  S  N  N
67159  GAGGATCGTCATGCCCCGGGAGCGGGAACACGCTCGATCGCCATGGCCGGTCGGCGTCCTCGTGCCGCATCACCCGGTCCCGGCTGGAGA
        < L  I  T  M  G  R  S  R  F  V  R  E  I  A  M  A  A  D  A  D  E  H  P  M  V  R  D  R  S  S  V
67251  CGAGGGTGACCGGGACCCCATGGCCGGTACGGCCAGGTACGCCGGTGACGGCCACCGGTTGACGCGGAACGACGACGATCAGGTGCTCGGGCAGG
        < L  T  V  P  V  G  M  A  L  Y  A  S  A  F  E  A  G  T  V  G  S  G  V  V  I  L  H  E  P  L
67343  TGCGGGCAGGTCGTACACCTGCTCCGCCAGGATGCGGTCAGGATGCGCTCCGCCACGGCCGTGGGGAGCTGGCGGCCGTGGCGAC
        < H  P  L  D  Y  Y  V  Q  E  W  T  L  I  R  E  G  D  P  V  A  T  P  L  Q  R  P  T  A  G  T  A  V
```

FIG.11A(58)

```
67435 CAGCACGGTCGACGCGTCGATCGAGTGCTTCTCGGAGCCGTCGGCCGGCGTGACGACGACGCGGTGGGTGTGGCCCAGCATGTCTCGCGA
       < L  V  T  S  A  D  I  S  H  K  E  S  G  D  A  P  T  V  V  V  R  H  T  H  G  L  M  D  E  G  L
67527 GCCGGGCCGTGCCGGCCACGAAGGTGACGCGCTTCGCGTGGATGTCGGCGACTTGCGGGCCAGGGCGAGCCGCTTGACCCGC
       < R  A  T  G  A  V  F  T  V  G  A  K  V  L  K  A  H  I  D  A  S  Q  A  L  A  L  R  K  V  R
67619 TCGTGCACGGCCCGGCGTCGACGGTGACGCCTCCAGCTCGGTGAGTGCACCCGAACTCTCGGTGTCCCGGTGTCCCGGTGACCACCTC
       < E  H  V  A  R  A  D  V  T  V  A  E  L  G  D  S  H  V  G  F  E  E  T  D  R  Y  G  T  V  V  E
67711 CGAGCTGGCGATGAACGTTTCGACGGTACGCAGTGCGGACAGCAGGCACGCAGGCACGCGGGCCTCCACCACGGTGACATCAGCGT
       < S  S  A  I  F  T  K  S  P  V  C  D  S  L  V  C  A  G  G  A  G  E  A  E  V  V  T  V  D  A  D
67803 CCAAACTGGGCGGCGACCAGGGCGCCTGTACCGGCCCCCCGCCGATGATCACGACGTCGTATTCTCCCCCAGCCGTCCGCGGGCTATCGTCATCGCCGTGCG
       < L  Q  A  A  V  L  A  A  E  Y  G  A  P  G  G  G  I  I  V  I  Q  S  V
67893 GCTCACAGTGACTTTCTCCCCGACGCGTCCGACACGCACCGTCCGACACGCACCGTCCGCGGGCTATCGTCATCGCCGTGCG
                                                                                > V R
67984 TCACTACGCGGCCTACGGCTCAAAACTGCGGGGTGAGGGCGGCGGCGGATCGGCTGCTGGGTGCTGGGTGATCGGGTGTTCGTG
       > H  Y  A  A  Y  G  S  N  L  D  P  A  R  M  R  A  U  C  P  H  S  P  M  V  G  V  G  W  L  E
68076 GCTGGGCGGCTCACCTTCGCGGGTGAGGGCGGCATCGGCTGGGAGGCGGATCGGCTGAGTCGTCAGTGATCGTCAGTGATCGGGTGATCGGGTGTTCGTG
       > G  W  R  L  T  F  A  G  E  G  A  I  G  W  E  G  A  V  S  T  I  V  E  S  P  G  D  R  V  F  V
68168 GCGCTCTACGACATCCACCCGTACGACGCGTCCAGCTCGACGAGATCGAGGGGTACGCCGACGGCGGCCTGCCGACGGCGTGGTATCTGTCGGAGATCG
       > A  L  Y  D  I  H  P  Y  D  A  V  Q  L  D  E  I  E  G  V  A  S  G  T  Y  R  K  L  H  V  R  V
68260 CTCCACCCTCGACGGCGACGTGACCGCGTGGGTCTACGTGTACGTCTTCGACGGGTACGAGGGCGGCCTGCCCACCGGCACGGCGTCGGCGTAGCGCGTCTC
       > S  T  L  D  G  D  V  T  A  W  V  Y  V  F  D  G  Y  E  G  G  L  P  T  A  W  Y  L  S  E  I
68352 CCAACGCCGGCTCGAGAAGGGCGGGCGCCCCGACGACTACGTCAGCGAGCTGCGCTCCCGCCCCACCGGCACGGCGTCGGCGTAGCGCGTCTC
       > A  N  A  A  E  K  A  G  A  P  D  D  Y  V  S  E  L  R  S  R  P  T  G  T  A  S  A  .
```

FIG.11A(59)

```
68443  CCACACTCCCAGTCTGCTCCGGCCCGAGACGGGGCCGCACGGGGCGGGGCCCCCGCGGGGGTCGTCTGTCACACATCATGGTCGCGCCCGTCACA
                                                                                           < · V
68534  CCGGCCGTGGGCGGGGACGGTGCGCTCGTCGTACATGTCGGTCCCAGGCGCATCTCGCGCAGCCCACCGAGCGGTAGAGCGTCGCCGGGGAGGTC
         < A T A A P V T R E Y M D T W R M E R L G V S R Y L T A P S T
68626  GGGTTGGTCAGGTCGACGCGGGAGGCCGGCGGTGCCGGCCGTGTTCGCCGTGAGACGTGAAGGCCCACAGCAGCGCGGGGCCGACCCC
         < P N T L D V G L G A H R R G K A A Y V T F A R W L L A A G V G
68718  GTGCGCCGGTACTTCGGCAGCAGGGTCCGCGACCAGGGTACCACCGACACCAGCCCGAGTCCTGTTCCAGCGCCTGGTCGGACGACTGCAACGCGGCCCG
         < P N T L D V G L G A H R R G K A A Y V T F A R W L L A A G V G
68810  GCTCCCCGTCGACCTCGGCGACGAACCACTCGTCGTACGGGTCCCCAGTTCCTGTCGTACGGCAGCGACGCTCCCGCCAGTGGTCGTACCCGGCCGGCTCG
         < H R R Y K P L V S L T R V W G S D Q W L A Q D S S Q L A G A P
68902  TAGTCCGGGGTGTCCCGGAGCGCCGTGTCGTAGATCGTGTAGAACAGGCGCCAGGTCCTGCGCGGCGCGCAGCGGCCGGACCGTCAC
         < E G D V E A V F W E D W T R D Y A P L R E R W H D Y G A P E
68994  CCCGGGTGGGGCCGCGCGCTCGGCGGGCCAGCCGGGCAGCTCCTCACCCGGCTGAAACCGGCTCGAAACCGGCTCACCGGCTCCTCGGTCA
         < Y D P T D R F A T D Y I R H F L R L D D E D G A R L P R V T V
69086  GCTCCGTCACCCAGGGGTCCGGGTAGGCCGGGGCGTGTACCGCCTCGGCGCGTGACGAGGACGTCGACGAAACTCCCGGCCCACCCGGTCGG
         < G P P P P E A P L G A L D R S M R V Y R K V R S F G A E T L
69178  TCCAGGCATCAGAGCGAGCCAGGAGCGACGAGCCGGCCTCGCTGACCAGGAGTCGCGCGGGTCGAAGAAGGGGCCGTCAGGG
         < E T V W R T E P P Y A S A R V T L A P L S R E A A R E A V R
69270  GTTGTCCACCACCGACCAGGCGACGAGCCGGCCTCGCTGACCAGGAGTCGCGCGGGTCGAAGAAGGGGCCGTCAGGG
         < D L M L A L L P A R V A E A R E P D V L V D V F E R G V G T P
69362  CGGCCTTGACGTCTTCGGCGTCGGGGTCGCAGTCCAGCGGGTGGCCGTGCGCGTGAAGGTGTCTGCGGCGTGCACGACGGGCGAGGATCCAGGGACGTCGTCG
         < N D V V D Q A V L R G Q P D S V L W S D R A P D F F P A T L A
69454  AGGGTGGGGCGGCCGCGCCCAGTCCTGCAGCGGGGAAGAGTCACGGGGCCGATCCTGGCAGCCACCCCGGTCCCAGCCCTCATTTTCAACCGC
         < A K V D E A D F D P H G I A F T D A A H V V A L I G P V D D
                                                                              <L T P R R A A W D A P L T V
```

FIG. 11A(60)

```
69545  CCCGCGCCCTGCCCCCGCCGCCGCTCGCCGGCGAGAGGGGACCCTTTCTACCCCAGGGCGTTAGTAAGGGGCCCTTCCTTGCACCAC
                                                                    <  ·   Y P A R G Q V V
69637  GGGCGGTGCGGTGGTCAGCAGGTCGAGCAGCGCGGTGCCCTCGGCCGGCGTGAGCGCCGGGAATCGGTGACACCAGCCGGTCGGTCACCG
       < A R A T T L L D L L A T G E A P T L A R F G T S V L R D R V A
69729  CCTCCGACCACAGCCGCCGGCGGCACCAGCGCCCAGCGGCCCCGGGGGTACGGCCAGGCCAGCGCGCCCGCCAGGCCAGCAGCAGCCCGGC
       < E S W L R R R V L P G V R P Y P P P W G C A L A G A E G E P
69821  CCGGCCAGCACCGCCTCCAGCGGCGTCATCCCGCCGGCCGTCACCGCCAGCAGGTACGCCCGGAAGTGCTCCCGAAGCAGCAGCAGCCC
       < G A L V A E L P T M G G A R V A L L Y A G A F H E R L L L G
69913  GGCGGCGGCACGGGCCCCGGGGTGTCGTCCGGCGGCGGCAAAAGAGTGGCATCCCGCTGGCGTCCGGCGTCGA
       < A A A R A G P T D D P P P V A R W A A F L P , G S A D A A D V
70005  CCACCCGGTGCAGCAGGCGTCGCCAGACGGATCACGCGGGGCGGTCAGGTGCTCGCCACGGCAGCACTCGGCCAGGTTCGCC
       < V R H L L T A L R I V G P V A T L H E S G W R C C E A L N A
70097  GTGGCCACCTCCAGCGGAGCGGTGCACGCGGGGCGGCGGGCGTCGGCGGGCGACGAAGCCGAGGCCCGCGCTCAC
       < T A V E L P A H V R A A A D W G S A V A D P A V F G L A A S V
70189  CGTGGCGGCCCCGACGTCGCCGAGCACCCCGGCGGCGGCGAGCTCCAGCGACTTGCTGCGGCGACCTGCTCCGGCGTCATCGGGTTCAGTCT
       < T A A G V D G L V G A R G A I H F A Q G S I G L L R A R H L T
70281  TGGCCAGCGGGCCCCGTGACAGCCCTTCCGTGACAGCCCGTCTTCGGCGGTGCGGCTGGGCGGCGGT
       < A P C R A F M E G L E L V L P K S A A A V Q E P T M <  ·  D
70372  GCCCCGGCCCGGCGGCGGGCGGGCGGGAAGCGGGGCGGCCCCGGCCCCTCGATTCGCCGGTGCGGCTGGGCGGCGGT
       < A G G P G E T V A G D E A D V A E I A G E I E G T R R Q A A T
70464  GACGGCCCGTTCCGACCGCGCGGGCCAGCTTCCGCAGTTCCTGCTGCGCGATCGCTGCTGCTCAGCTCCGGCCAGCGACC
       < V A R E A A R R A L K R R S L E Q E A A R S R E L E A L S R
```

FIG.11A(61)

```
70556 GCTCGATGCCGGTCAGTTCCTCGGACACCGTGTGTTGCTCGGGCCTCCTCGGCCGCTCCTCGGCCGCAGCTCCGCCGCTCCTCGGCCCGCTCCTCGGTCGGTACGCGCC
       < E  I  G  T  L  E  E  A  G  D  H  E  A  E  V  A  G  A  L  E  E  A  R  E  Q  D  T  R  A
70648 CGGCCCAGTTCCCGTTCCAGCATCCGGGCGTTGCCGGGCCCGCTCGGCACGGCGGGCGGCTCGGGGGCGGCGCGGCCCTCGCGCGGCCGCGCCTTCGCGCGCGG
       <R  A  L  E  R  E  L  M  R  R  Q  R  A  R  E  A  R  A  R  E  A  E  R  A  A  R  K  A  R  P
70740 TGGTGGGTGGGCGGTGGGCCTGCTCCTCGCCGTGACCAAACGGAGCTGGGGCGGGCACCTCGCCGGACCGGCGTAGCTGGCGG
       <P  P  H  T  P  P  P  Q  E  E  G  G  T  V  L  R  L  Q  P  R  P  V  E  G  F  G  A  Y  S  A  A
70832 CCCGCAGCAGCCGGCGGGAGCCGCTGCCCCGGCCACCTCGTGTCGGAGAGCGCGGCGTCGCCTCGAGCGTCGCCTCCACTGACTGAAGTGGAGCTGCCCAGCAGC
       < R  L  L  R  G  S  R  V  Q  G  A  V  E  T  D  S  L  A  A  D  L  T  A  E  V  E  G  L  P  L
70924 TTCCCGCCGGCCGGGCGCGCCCTCGGCGCGCCAGCCGGCGACCGGCGGGCTCGCGGACCAGCCGGGCCGTCGGGCTGGGCGTGGGCGGCA
       <K  G  A  P  P  G  G  E  A  D  A  A  L  R  R  A  E  A  V  L  A  A  V  A  A  R  R  Q  A  S  L
71016 TTCCCGCAGCCGGGGCCGCGCCAGGTCGCGCTGGGGCGCGCAGGTTGGGTCAGTTCGGCGAGTTCAGGTCGCTCAGTTGGGCGGATCTCGCGGGTGCCGGAGGCCGGGCC
       <E  R  L  R  P  G  R  L  D  R  Q  A  R  R  L  A  E  A  L  Q  T  L  D  A  V  L  E  P  R  R  L
71108 GGGCGAGCAGGTTGACGCGGTTGGCGGCCACGCGGTCGACGGCGATCTCGCGGGTCGTGGGCGGCTCTGCGGAGAGGCTCTGCGGGGCGGCGGCCACGGCTC
       < A  L  L  N  V  L  W  A  A  V  T  P  R  R  L  R  A  I  E  R  A  T  A  P  D  G  S  R  R  A
71200 TCGGGCACGGCCGGGTTGCGCGGTGCTGGACGAACTTCTCCGGCGGTTGAGGGACCGGTTGAGGACGGCGAGGCCGTTGTCG
       <E  A  V  A  A  D  R  T  A  V  F  K  E  P  P  E  T  Y  L  R  R  L  L  S  Q  P  P  P  V  <.
71291 AGACGTTGAGCAGCCGGCTGCGCTCCGAGGCGTCGATCGTAGTCGGTCTGGACACGCGGTACTGAGCGGCGATGAAGTTCGAGAACTTGGATGGGCGTG
       <V  D  L  R  S  G  P  Q  E  L  R  Q  U  D  T  G  S  L  A  A  Y  Q  R  N  L  V  A  L  G  N  D
71383 TTGAGCAGCCGGTCGTCGTGGCTCAGGGCGAAGGCTGCAGGCTCCACGGAAGTTCAGGCAGGTGTAGAGCGTCGTTCAGCAGATACCCGA
       <N  L  G  D  H  L  A  F  A  R  R  P  A  V  A  R  I  F  D  L  V  E  S  F  K  S  W  P  A  H
71475 GATCGGCCGCGAAGAGAGGTGTCCACGGGGCGTCCTCGGTGCCACCAGGGCGTCCACCAGGGGCGTGTGAGTGACCTGCGTAGATACCCGA
       <I  P  A  F  L  T  D  V  P  A  D  E  P  A  V  L  A  D  G  P  H  Y  V  V  D  N  L  L  Y  G  L
```

FIG. 11A(62)

```
71567 GGTTGTCCACGACCGGGATGTCGGAGATGACGGACCGCGTGCCGACCGCGTACGCGGCCACGCGCCCG
      < N  D  V  V  P  I  D  P  H  I  V  A  H  R  G  G  Y  A  R  V  A  V  G  A  A  T  F  A  Q  G
71659 GGTGAGATGGGCTTCGCGCACGTCGCGGAGGGGACCGGCCAGGGGCCGTAGATGCGGAACGGCCAGGCGGTCGAGCTG
      < P  S  I  P  E  L  A  E  A  V  D  G  L  A  G  A  L  S  A  P  G  Y  I  R  F  P  W  R  D  L  Q
71751 CCGGGTGAGAGCCGGCTCCAGGGGTGCTCATGGGTGATCAGCACGCTCCAGCGCGGTGCGGGTCGTCGAAGA
      < R  T  L  A  A  V  D  V  H  D  P  H  E  H  T  I  L  V  A  D  A  G  D  L  A  T  P  D  S  F  V
71843 CGCCCGGGGTCGACGACGACACCAGCAGCCGCGTGCTGCTCGACGCGGAGGCAGGAGTGGGCGGAATTTGGTGAGCTGCATCGTGACTCCTCGAT
      < G  P  D  V  V  L  V  G  G  D  H  E  V  R  L  C  S  H  A  F  K  T  L  Q  M
71933 TGACCCAATCGTGATGTCCCTCAGCGCAGTCTGCCGGAACGGCCGCGTCCGCGTCTGAGGTATCGCCCGATGGGCGTAGACGAT
                                                                                  > M  R  V  R  V
72025 CGGAGCGGGAATGACGGACAACGCAAGAGACGCAGGTTGCTGACCGCCGTGGGCGCTGCGGCCGCCGTGGTTGCAGCGCCGACA
      > D  D  V  D  A  A  A  R  S  A  I  T  A  V  T  G  V  G  G  F  V  G  G  D  E  R  S  S  G  G  T
72117 GCGATGGGCGGAGAGCCTTCGGCGGCGGTGGCGGTCCGGGTGGCGGGGTCGAACGCGGTCAATCATCTACACCGGAACCATGCGGGTGCGGGTGG
      > A  D  A  R  A  E  L  Q  L  R  V  P  A  E  R  F  T  A  V  L  E  E  L  A  R  L  G  R  Q  E  Q
72209 GGAACGCGGTCCGGCGCGGGTGGCGGTCGGGCTCACCGGGGTCGGCGGCTTCGTCGGCGCTTCGCGCGACGAGCGCGACAGCGGCGGAACC
      > R  A  I  R  T  E  D  V  T  E  E  T  V  D  L  D  A  R  I  A  T  Q  R  A  R  V  E  S  G  R
72300 ACGATGTGGACGGCGCCGCCGGTTCCGCCATCACGGGCCGTCGGCGGCCAGGAGTTGGCGAGCCTGGCCGGCAGGAGCA
      > K  L  L  A  R  A  T  S  I  G  D  L  V  T  L  E  S  E  V  A  R  R  E  A  D  L  A  S  L  E  A
72392 GCCGACGCCCGGGACGGGAGTTGCAACTGCGGGTGCCGGCGGTTCACGGCCGTCTGGCGGAGGAGTTGGCGAGCCTGGCCGGCAGGAGCA
      > A  D  A  R  A  E  L  Q  L  R  V  P  A  E  R  F  T  A  V  L  E  E  L  A  R  L  G  R  Q  E  Q
72484 GCGGGGCGATCCGCACGGAGGACGTGACCGAGGAGACCGTGGATCTGGATGCGCGGATCGCCACCCAACGGGCCCGGGTCGAGAGCGGTCGCA
      > R  A  I  R  T  E  D  V  T  E  E  T  V  D  L  D  A  R  I  A  T  Q  R  A  R  V  E  S  G  R
72576 AGCTGCTGGCGCGGGCCACCTCGATCGGCGACCTGGTGACCCTGGAGAGCGAGGTGGCTAGGCGGGAGGCCGACCTCGCTCGTGAGGCG
      > K  L  L  A  R  A  T  S  I  G  D  L  V  T  L  E  S  E  V  A  R  R  E  A  D  L  A  S  L  E  A
72668 AAGAAGCGCCGGCTGGCCGACCTGACCTCGCTCTCCACCATCACCCTGACCCTGGTCGGTCCGGAGGCCGGAGACACCGAGCCCGA
      > K  K  R  R  L  A  D  L  T  S  L  S  T  I  T  L  T  L  V  G  P  E  A  E  A  R  D  T  E  P  D
72760 CACCGGCTTCGTGGTCGGCCTGCGCGGCGGCGGCTGGACGGCGTTCGTCGCGAGCCTGGGCGTGCTGCTCACCGTGCTGGGCGCTGCCGT
      > T  G  F  V  V  G  L  R  G  G  G  W  T  A  F  V  A  S  L  G  V  L  L  T  V  L  G  A  L  L  P
```

FIG.11A(63)

```
72852 TCGCGGTGGCCCTCGGCGTGCCGGTGGCCGTGCTGCTTGCGGTGCTGCGCCGGCGTCGGCGGCGGCCGGCCGGCCGTCAACGCGCC
       >F  A  V  A  L  G  V  P  V  A  V  L  L  A  V  L  R  R  R  R  R  P  P  A  P  A  V  N  A  P
       >  P  P  V  P  A  A  R  S  A  P  .                                                <  .  R  A

72943 GCCGCCAGTGCCCGCAGCGCGGTGCTGCACCATGACCCGGAGGACGTCGACTTCAGTGCCCGCCATCTCGACGTTCGGGCCGGAC
      <A  A  R  L  A  T  Q  V  M  V  R  I  G  V  A  I  A  G  E  D  V  D  F  S  A  R  H  L  D
       <  V  N  P  G  S  R  G  V  G  L  R  A  L  A  G  P  V  Y  E  L  Y  W  S  F  D  E  G  G  M  S

73034 CGACGTTCGGGCTGCGGGACCCGGACCGGCCGAGGCCGGAAGCGCCCAGGCCGAGGCCGAGTACCAGGAGGAAGTCCTCGCCCATGCTC

73126 TGCGGGGTCTCCGAGACCCCTCCGGCCGAGCCGGCGGCGGCCTGGGTCGCCGTGTCGAGCACTGGGATGCCGGGCGTCGTTGGTCACCGGCGG
       <  V  N  P  G  S  R  G  V  G  L  R  A  L  A  G  P  V  Y  E  L  Y  W  S  F  D  E  G  G  M  S
       Q  P  T  E  A  V  G  E  P  G  L  A  A  H  T  A  A  T  L  V  Q  I  A  R  A  D  N  T  V  P  P

73218 CCGGCCGCGTAGGTACTCCAGGTCGACGTGCGCGGTGCGGCGGTGGGGGCGATGACGTCCCGCACCAGCGACGATCTTGGGGGCCTGGTCCC
      <  R  G  R  L  Y  E  L  D  V  T  A  G  T  P  A  I  V  D  R  V  V  Q  A  V  I  K  P  A  Q  D  W

73310 AGGTGTCGCGGTCCATCACCCGACGGCCAGGGTGCCGGAGGTGCCGGGGATCACGTTGTACCGGGATCTGCCGCGGGGCGTGGCCGAAC
      <  T  D  R  D  M  V  R  L  T  G  S  A  S  A  E  S  P  I  V  N  Y  R  T  G  A  S  A  H  G  F

73402 ACGAGCAGGCGAGCGGCCGTGTTGCCGGCCGGTGCCCCGGCGCGGTCGGTGAGCGCGGTGATCGGCGTGATCGGCCAGGTCGAC
      <V  L  L  L  G  S  N  A  P  V  R  R  S  V  L  A  P  V  E  T  V  L  R  G  L  A  D  V  L  D  V

73494 GGTCAGGTCGCGGAGCGGCGGTGTGCCCGGCCGGTGAGCGCGGTGTTGTCGGCGGCGGCGGTGATCGGCCGGATCCCCAGCGAG
      <T  L  H  P  R  A  T  H  G  G  P  G  T  L  R  V  T  V  N  D  A  A  A  T  I  P  G  V  E  L  G

73586 CGACCTTGCCACGCGGCTGGGTTGCGCAGTGCAGTCGCGAAGATCTGCACGACGTCGTCGAGACCGCCCAGGCCTCGATGACCTCCAGCGAG
      <  V  K  G  V  P  Q  N  P  D  V  H  L  A  F  I  Q  V  D  D  L  G  G  A  E  I  V  E  L  S

73678 CCGCAGGGCAGGATCTCCTCCGGCTGCGGAAGATTCAGCGGACCGGACGTCGTCCAATTCGCCGCCGAGGTTGGCCGAGTTGGGCAGCAGCACGCC
      <  G  C  P  L  I  E  E  A  P  Q  F  I  L  R  V  R  G  D  L  E  G  L  N  A  L  Q  A  L  L  V  G

73770 GACGCCGAGCAGCAGCACGGTGGTGTGCAGGCCAGGCGTGGCAGACACCGTCCTTGGTGGACCGGTAGGGCACGTCCTTGACGTCGG
      <  V  G  L  L  V  T  T  H  V  D  D  H  G  C  A  H  C  V  G  D  K  T  S  R  Y  P  V  D  K  V  D  T
```

FIG. 11A(64)

```
73862  TCAGCGGCAGCGCGTCGATGTCGGCGCGGAGCGCGACCACCGGGCCGTCGGGGCGGGCGGCCGTCGATGTGCGCAGATGACCCCGTTGCCCTTTGGC
        < L  P  L  A  D  I  D  A  R  L  A  V  V  P  G  D  P  R  G  D  I  V  G  N  K  P
73954  AGCAGGCGCGGGCGCAACCGGGCGACAGCTCGCGGGCGATCAGGCCGCGCTCTGCGAACTCCTCGCGGAGAGCTCCGGGTCCGGGAGTG
        < L  R  P  R  L  G  A  L  S  L  E  R  A  I  L  A  A  T  E  F  E  E  G  S  L  E  P  H S H
74046  GATGTGCCGGGTGGCGATAAGGCCATCCGGAGGGCAGAGATGGTCAGCCTGAAGGGCTCGAAAGGCTGCGACCCGGACGGCGGACT
        < I  H  R  R  T  A  I  L  G  P  M  R  L  A  L  L  H  D  L  E  F  P  L  P  Q  S  G  S  P  S E
74138  CCGGCCAGGCCGACGAGCCGTCGCCGTCAAGCACTCGTCACGTCGAAATCTCGATCACTAGAAACGGATGGATC
        < P  W  A  S  S  A  L  H  S  G  N  P  L  T  L  A  S  T  V
74229  ATCAGGGATGACAGCCGGCCAGCCTTCGACGGTGACTCTGTGCAACATCATTCCCGTAGCGATCGGACGCGCAGTCACGAATAC
          <.  F  R  D  S  P  R  Y  T  G  W  V  Q  R  L  T  G  C  V  E  G  V  T  A
74321  CCTGGTGGAAGGCTCCATAATCTGCGGGACAGCAGGTAGATCGCGGTTGAACGCCGTCATCTGCCCCCACCTCTACAACCGTAACCGA
        < R  A  R  L  A  E  K  M  P  H  L  V  N  A  T  G  E  A  A  A  R  L  E  G  L  A  R  E  V  A D
74413  TTCGGCGGTCACGAAATCACCGTCGATCGGGACGACTCGGACGAGTCGGCACTCGACGGCAGTCGACTCCCGGGGTGGCACACCAGGCGACCTGTCCGTCCGTCAACATGCTGTCGTCCAATCACCCGGACGGG
        < S  D  R  E  V  R  L  K  A  L  R  E  A  Q  A  A  E  I  T  P  D  V  R  L  P  E  Y  P  E  D A
74505  CGACCGCACTCGGCAGTCGGACGACTCCCGGGTGGCACACCAGGCGACCTGTCCGTCCGTCAACATGCTGTCGTCCAATCACCCGGACGGG
        < D  V  T  F  R  N  L  G  V  V  R  E  G  S  D  I  E  Q  A  I  R  Y  A  S  Q  E  I  E R
74597  TTACCCACTGCCCCCGGGTGGCACAGGTGCGCACCAGGGCAACCTGCCCACACCGTGCCACAGGTGCCACTCGCCACCGTGCC
        < D  V  T  F  R  N  L  G  V  V  R  E  G  S  D  I  E  Q  A  I  R  Y  A  S  Q  E  I  E R
74689  CTCATCCGAGACAAGGGGTCAGAAACCGGTCGCTCGGGTCGCTGGGGCAGGCGGTACGTCCCCACACCGTGCCACAGGTGCCACTCGCCACCGTGCC
74780  CGGGCCCGCCAGCCTCCTTCATCGGGTGCAGCAGTTGCAGCGTTCGCCGGCCCGGCGGTCGGTCTCGACGCGGTC
        < Q  F  G  A  E  I  A  D  V  V  S  G  H  D  A  V  R  E  M  L  E  V  V  A  A  E  I  E  A T
74872  GCTGTCGCCGCTCCACTGCAGCTTGGCCAGCCTGCGCTCGGCCAGCGCCGAGTCCTCCTGGGCATCGGTAGCGGTCGTACGCCGCTCGTCGG
74964  CGTCGACCGGTGAAGCCGGTTGAGGCCGACGGCGTCGAACCCGAGCCGTGGTCGGCCACCCGCCGTCCACCAGCTCATCAGCTCCATCAGCTGCAGCCGCCGT
75056  TTCTGAAGCCCGCCTCAGCCCTCGATGGCGTCGACCACGTCGGACCCAGCCGAGCCGTGGTCGGCCACCCGCCGTCCACCAGCTCATCAGCTCCATCAGCTGCAGCCGCCGT
        < K  Q  F  G  A  E  I  A  D  V  V  S  G  H  D  A  V  R  E  M  L  E  V  V  A  A  E  I  E  A T
```

```
76252 GATCGGGAAGCCGGACTCGCTCGACCGCGTTCACTCATCCCGGATGGTAGGACGTGCCACCGCCGGAGGGTGAGGGATTGCGCACAT
      < I P F G S E S S R P E S M
76343 CGCACCCCTGTCTTTCCCGCGACTCGAGGGTGAAACACCTGGCTCGCTCCGATTAGGTAAACGTTCCGCCGTCGGGTTTCGCA
76435 TCGGGCGTCGGAACCAGCAGTCAGCCGTCCAGCCCTCGATTTCCCCGGTGGCTCTTCTGTGACTCAGATCCGACGTGGA
76527 GCGGGCGGGACCAGTCAGCGACCGCACCCCGACGTGCGGCAGCCGGACCACCATCGGTACCGCTCCGGTCCGGCCAATGGC
76619 GGCATGGGCACGGTCTGGCGTGCCACAGACACCCTGCTGCGGCGACGTGGCGGTGAAGGAGTCGTCCCCGGCCTCGCCCGA
      >  M G T V W R A T D T L L R R D V A V K E V V L P P G L A P
76710 GCGACCGCGACGTACGAAGCCATGTACGAACGCACCCTGCGAGGCCCGCGGGCCATCCAGCACCCGGCCGTGGTCCAGGTGTACGACGTG
      >S D R D A M Y E R T L R E A R A A A I Q H P A V V Q V Y S V
76802 GTCACCGAGGGTGGTCGCCCCTGGATCGTGATGGAGCTGCTGGACGCCAGCCTGGCCGACATGGTGATCGAGGACGGGCCGGTGGCCCC
      >V T E G G R P W I V M E L L D A R S L A D M V I E D G P V A P
76894 CCGCGCGGGTGCGCCAAGATCGGCATCGCCCTGCTCGGGGCTGCGGTGCTGCACGCGATCGGGGTGCTGCACGTGCTGAAGCGGCCA
      > R A V A K I G I A L L G A L E V A H A I G V L H R D V K P A
76986 ACGTGTGATCTGCACCGACGGCCGGTGCGTGCTGACCGACTTCGGGGTGGCCAAGCTCCCCACGGACGTGCAGTTCCAGCCGGGGATG
      >N V L I C T D G R C V L T D F G V A K L P T D V Q L T T P G M
77078 GTGTCTCGGCTCGCGCCACTTCATCTCCCCGAGCGAGTTCGGGCCATGGGCCAAGGAGTTCGGGCCCCCGAGCGACCTGTTCTCCCTCGGCGTCACGCT
      >V L G S P H F I S P E R A M G Q E F G P P S D L F S L G V T L
77170 CTACACGGCGGTGGAGGGCCGGCCGCCGTTCGACAGGGGCGGACCCATGCACGCCGTGGTCGAGGAAGGACCCGCCACGCCGC
      > Y T A V E G R P P F D R G D P I E T M H A V V E D P P A T P
77262 AGCCGCAGCGGCTCGGCCCGCTGACCCGGGTGCTGATGGGGCTGCTGGAGAAGGACCCGGCCCGCCGCCTCGACGTGCACACCGCGCGGATGCTC
      >Q R S G P L T R V L M G L L E K D P A R R L D V H T A R M L
77354 CGCGAGCTGCTCGCCGGGCCGCTGACCAGCACCGCCGTCAACTCGGTCACGGACCCGTACGCGGTGGTGCCGGTCAAGCAGCGCCC
      >R E L L A G P L T S T A T A V N S V T D P Y A V V P V K Q R P
```

FIG.11A(67)

```
77446  GGCCGTCGCCCCACCGCCCTCCGTGCGGAGCCGAAGCCGAGCGGGCAGATCGGCGGCGGGCCGGGCGAGTGCTGACCG
       >  A  V  A  P  P  P  S  A  A  E  P  K  P  S  G  Q  I  G  G  R  A  M  L  A  P  G  E  S  L  T
77538  ACCGGCTGGCGGCCCTGCGCCGGGGCGAGAAGACGAGGAAGAAGACGACGACCGCCGCCGCTGGACGACGACCAGCGCCGACGCGCTT
       >  D  R  L  A  A  L  R  R  G  E  K  T  R  K  R  K  T  T  A  A  L  D  D  T  S  A  D  A  L
77630  GCCGGGCCCGCTGCACACCCCCGGAGAGCCATGCCAGCGGGAGGCCACCCAGGCAGCGGGACGTACGCGGTTCGTCGGAGGCCACCCAGCGGGT
       >  A  G  P  L  H  T  P  T  G  A  M  P  A  P  P  P  A  G  R  T  Y  G  S  S  E  A  T  Q  R  V
77722  CGACGCGGGGACGGCGCCTGCCGGAGGCCACCCAGCCGGATGACGATGAGCGGAGGCACCGCCCGACGCAGCGGGGTGTCCCACGGGAGCGGGCCCGT
       >  D  A  G  T  A  P  E  A  T  Q  R  M  T  Y  G  S  P  P  D  A  T  Q  R  V  S  H  G  S  G  P
77814  CGGAGGCCACCCAGCGGGTGCCCTACGGCGGCGGCTCGGCAGACGCCACCCAGGTGCCCTTCGGTCGCGGACGCAGCGG
       >  S  E  A  T  Q  R  V  P  Y  G  G  G  S  A  D  A  T  Q  Q  V  P  F  G  R  R  P  D  A  T  Q  R
77906  GTCCCCTACGGCAGCCAGCCCGGCGCGACGCAGCCGGCTTCGCCGGACGCGTCGCCAGCGGGTCGGCGGGGTCGGCGTACGG
       >  V  P  Y  G  S  Q  P  G  A  T  Q  P  V  P  G  F  G  A  S  P  D  A  T  Q  R  V  G  G  A  Y  G
77998  CGGCGGCCAGTGGTCGGTGCCGGCCAGCGTGGGCACGGGCCAGCCGTGGGCCACCCCGGCCCCGGCCCGCGCCCGGCGGCGGCGGGGTCG
       >  G  G  Q  W  S  V  P  G  T  G  Q  P  W  A  T  P  A  T  P  A  P  A  T  A  G  G  G  G  V
78090  GCCGCCCTCGTCGCCACAGGCTGCCGCGCAGGGGCACCCGAGGGGCCACCCGGCCGGGCCGGGGTGATCGGCGGTGTTC
       >  G  R  L  V  A  T  V  K  G  W  P  R  K  V  Q  L  A  A  A  G  G  V  A  V  L  L  L  I  G  V  F
78182  GCCCTCTTCGGCGGCGACGACCCGGAGCAGCCCGACCAGCCGACATCCTGCAAGGGCTGGAGAGCAGCCCCAAGGGCTGGTCCTGGGGCCCTCAGGTGCAGTGCCAGCAGTGCCCCAGCAGGCCGGACAGGGGCGTGTGGGTCGACTACATCGATC
       >  A  L  F  G  G  D  D  P  E  Q  P  T  T  P  Q  G  Q  P  S  A  G  A  P  A  G  P  G  V  E  M  Q
78274  GGAGCAGTGCCAAGGGTGTGGTCCAGGTCCATCCTGCCGGTGTGGTCCAGGTCCAGGTGCAGGTGCAGGTCCAGAGAAGAAGCCGCGCCGGGGCTGGAGCC
       >  E  Q  S  A  K  G  V  T  V  Q  V  P  K  G  W  E  R  R  S  A  D  G  G  V  W  V  D  Y  I  D
78366  CGGAGGACAACAGCCGCAAGGTGCGCATCCTGCCGGAGAGGTGGAGCGGCACGAGCACGCGCTGGGCCGAGACGGCGGCGAACGGCCTGCGG
       >  P  E  D  N  S  R  K  V  R  I  L  A  E  R  W  S  G  T  S  T  R  W  A  E  T  A  A  N  G  L  R
78458  ACCCGGTCGGCCTCCTGCCAGAAGCCGTACAACCAGGTGTCGATGACGGAGCAGGAGCTGGACGGCAAGGCGGCGGCGGAGTTCGAGTACAC
       >  T  R  S  A  S  C  Q  K  P  Y  N  Q  V  S  M  T  E  Q  E  L  D  G  K  A  A  A  E  F  E  Y  T
```

```
79560 CCGCCGCCTTCGCCCGCGCCGGGCTTCGGCCATCCCCGGCGTGGTGCCGAGCAGGGCGGTGCCGGAGACTTCCGGACCGTCAGCTTCCCC
      >T  A  A  F  A  R  A  G  F  G  I  P  G  V  V  P  E  Q  A  V  P  D  P  D  F  R  T  V  S  F  P
79652 AACCCGGAGGAGCCGGGGGCGGTGGACCTTGTCCTCGTCGCTCGCGGAGACCTGGCTGCCAACGACCCGGATGCCAACGACCCGGACGCGGA
      >N  P  E  E  P  G  A  V  D  L  L  V  A  L  A  E  R  T  G  A  D  L  A  I  A  N  D  P  D  A  D
79744 CCGCTGCGCGGGTGGCCGTCCGCACGCGGAGCGGCTGGGGGCGCTGGAGTGGGGGCGCCTTGCCGGATGTGAGCGGAGAGGTGG
      >R  C  A  V  A  V  R  D  G  R  A  A  G  P  A  P  V  S  G  G  A  W  R  M  L  R  G  D  E  V
79836 GGGCGCTGCTCGCCGACCATCTCATGCGTCGTGGCGTCCACGGCCTGTACGGCCTTGTCGTCCTGTCGTCGTACGGGCCATGTGC
      >G  A  L  L  A  D  H  L  M  R  R  G  V  H  G  L  Y  A  T  T  I  V  S  S  L  L  R  A  M  C
79928 GCCGCCCGTGCCTGCCGACGAGACGCTGACCGGCTTCAAGTGGATCGTCCGGGCCGGAGGAGGGCCGCTGGGTGAGGCCGGCTCCGA
      >A  A  R  G  L  P  Y  D  E  T  L  T  G  F  K  W  I  V  R  A  G  G  G  P  L  G  E  A  G  S  D
80020 CCCGGTGCTTCGGCTCTTACGAGGAGGCGCTGGGCTACGTGCCCGAGCACGTTCGCGACAAGGACGGCATCACCGCGCTGACCG
      >P  L  V  F  G  Y  E  E  A  L  G  Y  C  V  A  P  E  H  V  R  D  K  D  G  I  T  A  A  L  T
80112 TCGCCGAGTGGCCGCCGGAGCTGGCGGCCGAGGCCTTCGGCGTGCACCACACC
      >V  A  E  L  A  A  G  L  K  A  Q  G  P  T  L  T  D  R  L  D  E  L  A  A  E  F  G  V  H  H  T
80204 GACCAACTCTCGGTGCGGGTGGACGACCTGCGGATCATCGCCGACGCGATGGCCCGGGTCCGGGCGCGGACCCCTACGCTCCTCGGCCG
      >D  Q  L  S  V  R  V  D  D  L  R  I  I  A  D  A  M  A  R  V  R  A  A  T  P  T  T  L  L  G  R
80296 CCCGGTGACCGAGGCCGGGACCTTGCTCCCCGAGGCGGACGTGGTGATCCTGCGTACCGACGGGGCACGGGTGGTGATCCGCCCGTCGGGCA
      >P  V  T  E  A  R  D  L  L  P  E  A  D  V  V  I  L  R  T  D  G  A  R  V  V  I  R  P  S  G
80388 CCGAGCCGAAGCTCAAGGCGTACCTGGAGGTGGTCGAGCCGGTGGCCGACGGCGACGTGCCGGCGGCCCGGACGCGGGCCGCCACGCTG
      >T  E  P  K  L  K  A  Y  L  E  V  V  E  P  V  A  D  G  D  V  P  A  A  R  T  R  A  A  A  T  L
80480 GCGGCACTCCGCACCGAGATCGCCGCACTCGTGCAGGGATGAGAGGTGTGCTCCGACGCTCTCTCAGCGGGTTGGCGTGTGCCCC
      >A  A  L  R  T  E  I  A  A  L  V  Q  G  .
80571 CAGGTTCGTGGTGATGAGGTGAACCCGGAGCCCAGGTAAGCCACCGTCCTGCCACTATCCATGTCGTAGAACATGATGCTGCCACTTGGATGTAGTAGTAG
80663 GTGACCAATGAGGTGAACCCGGAGCCCTGTTTGAGCGTGTACGTAGCGCCGAAGCCACTGGCAGTCACATCGTTCCGTT
```

FIG. 11A(70)

```
80755  AGCGCTCGCGTAGCTCAGGCAGCAGGAACATCCTCCCGCCATAGGATACAGCAGCTGGCTGGTGTATCCCTTCTGAAGGGCTTTGCAG
80847  GTTCTGCCGGCAAGGGCGAGAGGTCCTGGGCCTCGTCTTGATCACGATCTCGTAGAGCCGGACATCGGCGTCTCGGTGTTGTACGCCAGG
80939  ATGACCGGCACCGGCAAGGTGTTTGGGAGGGTGACCGAGAACATGAACTGCCGTCTGTCTTGTTGTACAGGAACAGCCACTGCCGCTTCCACCCTCGCCGT
81031  GGCGGGCCCGTCGAGGAATAACTACGGAAACATGCCGTCTGTCTTGTTGTACAGGAACAGCCACTGCCGCTTCCACCCTCGCCGT
81123  TCACCTCGAAGGGCGCTACGGACGACCATCCAGCGCCCCAGTTGTCCTTCTGGCCATCAGGCGGCCACACCTGCTCGCAACGTCTTCGTTG
81215  TCCACAACCTGCCACACGGCTGTTGCCGGTCAAGGGCAGGCATCGTAGAGCTGGACATACCGCCTGTCTTCTGCACGACGGAACGACGGAGGT
81307  CCACCCCTTCCGAAATTGCGCTGCCAGCGGGGAGGCCACTGTAGTGCCCGTCGTGGGCCATTGACTGGACCGAAGGCGGCCGTGCCGT
81399  CATTGCTGTTGTAGAACAGACCATTCCGGAGTGACATGGGTTTACCCCGTCCTAGGGATCACTGCTTCTCAACAGATCATCAACGGCCGAGTTGGACA
81491  TCATAGAGACATTCCGGAGTGACATGGGTTTACCCCGTCCTAGGGATCACTGCTTCTCAACAGATCATCAACGGTGTGCGAGGCTGCA
81583  CAATCGGGTGGAAGAGAGCCATCTGTCGGGCGTGTCGAAGGTGCGGCTGTTCGCACGTATCGTCTGACCTCTCGACCGGGCCGAGCAGGGTGCCCTCCGCGTCACGGGT
81675  AGCGTTCCGCGCATCTGTCGGGCGTGTCGAAGGTGCGGCTGTTCGCACGTATCGTCTGACCTCTCGACCGGGCCGAGCAGGGTGCCCTCCGCGTCACGGGT
81767  TCTGCCACGAGGGCCCTCGTGCCCAGAGCGGCCAGGAACCGGGGAAACGCGACCGGCAAGGCCACGCTCGTTGCGACCGTGATCCCTTGCCCACGAAGGCTCGTCTGAATAGCATCAGCACAT
81859  CGGCGGCCACCGGAAACGCGACCGGCAAGGCCACGCTCGTTGCGACCGTGATCCCTTGCCCACGAAGGCTCGTCTGAATAGCATCAGCACAT
81951  CAGGCCCACCATTACCCGCACCATTGGCTGACGTCCGCGCCAGCGGCGACCGAGCTCGGCAGCTGCTACTCCGCGAGAGCGCCATATCAGCA
82043  TGCACGGTGCGTGAAACAAATGGCTGCGTGAAACAAATGGCTGACGTCCGCGCCAGCGGCGACCGAGCTCGGCAGCTGCTACTCCGCGAGAGCGCCATATCAGCA
                                                                          >V  P  R  R  Q  L  G  R  L  L  T  Q  L  R  E  S  A  H  I  S
82134  TCGACGCGGGTGGCGGCGGCGGGCGAGCTGGACTGCTCGCGCGGAGAAGCTCTGCGGGATCGAGGGGCTGACCTCGGCCAAGACACCGGACGTCCGG
       >I  D  A  A  A  G  E  L  D  C  S  R  Q  K  L  W  R  I  E  R  G  L  T  S  A  K  T  P  D  V  R
82226  GTGCTCTGCGAGCTGTACCGGGCCACGCCCGACCAGGCGAGCGTGCTGCTCGGCCTGGCCGAGGTGAGCCGGGCCGAGGGTGGTGGCACGGC
       >V  L  C  E  L  Y  R  A  T  P  D  Q  A  S  V  L  L  G  L  A  E  V  S  R  A  E  G  W  H  A
82318  CCACGGCAGCTCGGTGCCGGCCTGGTTCTCGCTCTACGTCGGACTGGAGAACGTCGCGAGCAGCATTCGGCACTACAACGCGGAGCTGGTGC
       >H  G  S  S  V  P  A  W  F  S  L  Y  V  G  L  E  N  V  A  S  S  I  R  H  Y  N  A  E  L  V
82410  CGGGGCTGTTGCAGAGACCCGGCTACGCCACGGCGCTCTTCGAGCACAACCGGCCTGGGCGAGGGCGAGGAGGAGAGGAAAGAAGGCGGTGGGC
       >P  G  L  L  Q  R  P  G  Y  A  T  A  L  F  E  H  N  R  P  E  L  G  E  E  E  R  K  K  A  V  G
```

FIG. 11A(71)

```
82502 TTCCGGACTCAGCGGGCAGGGGCTGCTGGCCCGGCTGCCCCGGCGGCTGCCCCCGGCCCCCGAGCTGACCGTGATCCTCAGCGAGGCGGTGCTGCGCCGCCC
      > F  R  T  Q  R  Q  G  L  L  A  R  R  L  P  P  A  P  E  L  T  V  I  L  S  E  A  V  L  R  R  P
82594 GGTGCCCGGGCCGATCGGTGCCGACCAGCTCCGGCACTTGCTGGCCGTGGGCGAACATCACGGTACGGGTCTGCCGCTGG
      > V  P  G  R  S  V  M  A  D  Q  L  R  H  L  L  A  V  G  E  R  H  N  Q  T  V  R  V  L  P  L
82686 CCGGCGGGGCGCCGCTGGCCGCCGAGGCCGGACTTCGTGCTGCTGGACTTCCCGCTCTCGGCGCTCGGCAGCCCGACCGAGCCGCCGACC
      > A  A  G  P  P  L  A  A  E  A  G  T  F  V  L  L  D  F  P  L  S  A  L  G  S  P  T  E  P  P  T
82778 GTCTACGTCGAGGGCTCACCGGCGCTCTACCTGGACCAGCCGGAGATCGCCGCGTACGAGCGCGTCTGGAGGGGTCTGGATTCGCT
      > V  Y  V  E  G  L  T  G  A  L  Y  L  D  Q  P  T  E  I  A  A  Y  E  R  V  W  R  G  L  D  S  L
82870 CGCCCTCGGCGCGCGACAATCAGCGAGCTGATCGATGCTATGAGTGATCTGACCGGCGCCCGTGGCGCACCAG
      > A  L  G  A  R  Q  S  A  E  L  I  D  A  I  R  G  E  C  Y  E  .
82961 CACCCGCAGCGGCCACCAACGGGCGGGGACTGCGTCGAGGTGGCCGACAACCTCACCGGCATCGTCGTCGGGACAGCAAGGACCCGGGCG
      <  .  A  R  K  G  L  A  A  D  V  A  K  G  L  A  T
83053 GGCCGGCCCTGACCGTCCCGCCGCCCTTGTTCGCGCCTTCAAGGCCAGCTCAAGTCAACCGCTGACAGCTCCGCAACGAA
      <  V  V  L  A  V  S  P  R  V  V  S  D  D  L  S  V  T  G  S  F  G  A  G  G  A  I  E  E  L  R  R
83145 CCAACCCCGGCTACGCCGAGACGCCGGCGCCGTCAGAGGCGCGCCTTGCCGAGGGCGGCGTGCCGCCTTGCCGAGGCGGT
      <  R  A  D  V  A  A  D  G  T  L  G  L  A  P  E  M  R  L  V  A  V  L  T  A  L  A  A  T  A  E
83237 AGCCCGGGGCAGGGCCCAGGCCGCCCAGGCCCGGCTCGACGATCCGGAGGTGCCGGAGAAGCCGGGCGATCTCCTCAGCCGAC
      <  D  P  I  Q  G  G  A  L  A  E  A  L  R  R  S  D  R  R  V  T  A  D  T  P  Y  R  H  V  H
83328 GACGACCAGGGCGTCGAGGGGCGAGTCGTCCAGGCTGACGGTGCCGGAGAAGCCGGCGATCTCCTCCAGCCGAC
      <  V  V  L  A  V  S  P  R  V  V  S  D  D  L  S  V  T  G  S  F  G  A  G  G  A  I  E  E  L  R  R
83420 GCCGGGCTGCGTCGACGGCGGCGTCGCCGGTCAGGCCGAGCGACCGCGGACCAGGGTGGCCAGGCGGCCGTCGCCCTCG
      <  R  A  D  V  A  A  D  G  T  L  G  L  A  P  E  M  R  L  V  A  V  L  T  A  L  A  A  T  A  E
83512 TCGGGGATCTGCCGCCGCCCAGCCGCCGGCCAGCCGCTGCCGCCACCACGCCGACCAGGTGCGCGACCGGATCCGGAGGATCCGGAGGATCCGGCGACCGGGTCCGGGTAGCGGTGCACGTG
      <  D  P  I  Q  G  G  A  L  A  E  A  L  R  R  S  D  R  R  V  T  A  D  T  P  Y  R  H  V  H
83604 GATGAAGCCCAGCTCGGTCTCCTCGACGTCGCGGTCGAGGATCCGGGCGACCAGGTCGCCGAGGATCCGGCAGCCGCAGCC
      <  I  F  G  L  E  T  E  E  V  D  R  V  V  G  R  A  V  L  D  G  L  I  R  D  R  L  G  H  R  L  R
```

```
84980 GGCGTGGACCAGGTCGGCGCGGGAGCAGCGGGCGGCCCAGCTCGGCCACCCGCTCGATCAAGACCACGGCCAAGGCCCGGGCGATCGACCTGGC
     > G  V  D  Q  V  G  A  E  Q  R  A  A  Q  L  G  T  R  S  I  K  T  T  A  K  A  R  A  I  S  L  A

85072 GATCCGGATGGTCGACCTGACCACCCTGGAGGGCGCCGACACCCCCGGCAAGGTCGCGGCGCTCGCGGCCAAAGCACTGCGCCCCGACCCGG
     > I  R  M  V  D  L  T  T  L  E  G  A  D  T  P  G  K  V  R  A  L  A  A  K  A  L  R  P  D  P

85164 CCGACCCGTCCTGCCCGCACGTCGGCGCAGTCTGCCCGGTACCCGGCGATGGTCCCGGCATACGTGGCCGAGGTGCTGCGCGGATCCGCGGGTCC
     > A  D  P  S  C  P  H  V  G  A  V  C  V  Y  P  A  M  V  P  Y  V  A  E  V  L  R  G  S  A  G  S

85256 GGGCGGCCGTCCGGCGGACGGCAACGCGCCGGACCCGGCGTGGTGCACCGGCCACCGCGTGTGGCCACCGCGTTTCCGTCCGGGCA
     > G  R  P  S  G  G  P  D  G  N  A  P  A  G  P  G  V  V  H  L  A  S  V  A  T  A  F  P  S  G  Q

85348 GGCACCCCTGGAGGTCAAGCTCGCGGACACCCGGGCCGCAGTGGCCGCAGTGGCGGCGGACGAGATCGACATGGTGATCAACCGGGGCGCGTTCC
     > A  P  L  E  V  K  L  A  D  T  R  A  A  V  A  G  A  D  E  I  D  M  V  I  N  R  G  A  F

85440 TGGCCGGCCGCTACCGCGAGGTCTACGACGAGATCGTGGCCACCAAACAGGCGTGCGGGGACGCCCACCTCAAGGTGATCCTGGAAACCGGC
     > L  A  G  R  Y  R  E  V  Y  D  E  I  V  A  T  K  Q  A  C  G  D  A  H  L  K  V  I  L  E  T  G

85532 GAGCTGGCCACGTACGACAACGTGCGCCGGGCCAGCTGGCTGGCCATGCTGGCCGGCGGCGACTTCATCAAGACCTCGACGGGCAAGGTTCC
     > E  L  A  T  Y  D  N  V  R  R  A  S  W  L  A  M  L  A  G  G  D  F  I  K  T  S  T  G  K  V  P

85624 CGTCGCGGGCGACCCTCCCGGTGATGCTGGAGGCGGTCCGCGACTTCCGGGCCGCCACCGGGCGGCAGGTCGGCGTGAAGCCGG
     > V  A  A  T  L  P  V  T  L  V  M  L  E  A  V  R  D  F  R  A  A  T  G  R  Q  V  G  V  K  P

85716 CCGGGGGCATCAAGAACACCAAGGACGGCATCAAGTACCTGGTTATGGTCAACGAGACCGTCGGCCCCGGACTGGCTGGACCCGGACTGGTTC
     > A  G  G  I  K  N  T  K  D  A  I  K  Y  L  V  M  V  N  E  T  V  G  P  D  W  L  D  P  D  W  F

85808 CGGTTCGGCGCGTCCAGCCTGCTCAACGACCTGCTCATGCAGCGCACCAAGCTGACGACGGCGTCTACTCCGGTCCGACTACTTCACCCT
     > R  F  G  A  S  S  L  L  N  D  L  L  M  Q  R  T  K  L  T  T  G  V  Y  S  G  P  D  Y  F  T  L

85900 GGACTGAGGCGTGATCTTCGAATACGCGCCCCCGAGTCCGCTCGGTGGTGGACCTCAAGCCCTCGTACGGGCTGTTCGTCGACGG
     > D  .  > V  I  F  E  Y  A  P  A  P  E  S  R  S  V  V  D  L  K  P  S  Y  G  L  F  V  D  G

85989 GGAGTTCGTCGACCCGGCCGACGGCGGCGGCTTCAAGTCGGTCAACCCCGCCTCGGAGGAGGTGCTCGCCGAGATCGCCGAGGCGGGCAGCG
     > E  F  V  D  P  A  D  G  G  G  F  K  S  V  N  P  A  S  E  E  V  L  A  E  I  A  E  A  G  S
```

FIG.11A(74)

```
86081 CCGACGTGGACCGGGCGGTCCGCGCCGGCCCGGACGGGTACGAGAAGGTGTGGGGCCCGATGCCGGGCCGGGACCGGGCCAAGTACCTGTTC
      > A  D  V  D  R  A  V  R  A  A  R  T  A  Y  E  K  V  W  G  P  M  P  G  R  D  R  A  K  Y  L  F
86173 CGGATCGCCCGGATCATCCAGGAGCGCTCCCGCGAGCTGGCCGTGCTGGAGTCCCTGGACAACGGCAAACCGATCCGGGAGTCCCGGGACGT
      > R  I  A  R  I  I  Q  E  R  S  R  E  L  A  V  L  E  S  L  D  N  G  K  P  I  R  E  S  R  D  V
86265 CGACCTGCCCGTGGCCGCGCACTTCTTCTACTACGGGGCTGGGCAGACAAGTGCCTGCCGTACGCGGGCTTCGGCCCGAACCCCGGCCGC
      > D  L  P  L  V  A  A  H  F  F  Y  Y  A  G  W  A  D  K  L  P  Y  A  G  F  G  P  N  P  R  P
86357 TCGGCGTGGCCGCGCAGGTCATCCCGTGGAACTTCCCGCTGCTCATGCTGCTCGAAGATCGCCCGGCGCTGGCCGCCGGCAACACGGTG
      > L  G  V  A  A  Q  V  I  P  Q  N  F  P  L  L  M  L  A  Q  K  I  A  P  A  L  A  A  G  N  T  V
86449 GTGCTCAAGCCGGCGGAGACCACCCCGCTGACCGCTGTTCGCCGAGATCTGCCAGCAGGCCGAGCTGCCGGCCGTGGTCAACAT
      > V  L  K  P  A  E  T  T  P  L  T  A  L  L  F  A  E  I  C  Q  Q  A  E  L  P  A  G  V  V  N  I
86541 CGTCACCGGCGCGGGCGACACCGGTCGCGCCCTGGTCGAGCACCCGGGCGTGGACAAGGTCGCGTTCACCGGCTCGACCGAGGTCGGCAAGG
      > V  T  G  A  G  D  T  G  R  A  L  V  E  H  P  G  V  D  K  V  A  F  T  G  S  T  E  V  G  K
86633 CCATGCCCGGTCGCGGCACCGGCAAGAAGGTCACCCTGGAAGCATCTTCTTCAACCAGGGCCACGTCTGTCGCCGCGGGTCCGAGGAGTCGGT
      > A  I  A  R  S  V  A  G  T  G  K  K  V  T  L  E  L  G  G  K  A  A  N  I  V  F  D  D  A  P  V
86725 GACCAGGCGGTCGAGGGGATCGTCAACGGCATCTTCTTCAACCAGGGCCACGTCTGTTGCGCCGGGTCGGAGCTGCTGGTCCAGGAGTCGGT
      > D  Q  A  V  E  G  I  V  N  G  I  F  F  N  Q  G  H  V  C  C  A  G  S  E  L  L  V  Q  W  S  V
86817 CGCCGAGCAGGTCCTGGAAAGCCTGAAGCGCCGAATGGCGCTGCTGCGCGTCGGCGACCCGCTTGACAAGAACACGGACATCGGGGCGATCA
      > A  E  Q  V  L  E  S  L  K  R  R  M  A  L  L  R  V  G  D  P  L  D  K  N  T  D  I  G  A  I
86909 ACTCGGCCGCCCAGCTGGCCCGCATCCGCGAGCTGTCCGCGGCGGGGGCGAGGGGGGAGGCGGAGCGCTGGTCGCCCGTGCGAGCTGCCC
      > N  S  A  A  Q  L  A  R  I  R  E  L  S  A  A  G  E  A  E  G  A  E  R  W  S  P  P  C  E  L  P
87001 GAGCGCGGGTTCTGGTTCGCCGACGATCTTCACGGGGGTCACCCAGGCGTCGAGAAGGCCAACAACGCGTACGGCGTGTCGGCCGGATCTTCGGTCCGGTGCTGTC
      > E  R  G  F  W  F  A  P  T  I  F  T  G  V  T  Q  A  H  R  I  A  R  E  E  I  F  G  P  V  L  S
87093 CGTGCTGACCTTCCGCACCCCGGCCGAGGCCGTCGAGAAGGCCAACAACCCGTACGGGCTGTCGGCCGGGATCTGGACCGACAAGGGGCT
      > V  L  T  F  R  T  P  A  E  A  V  E  K  A  N  N  T  P  Y  G  L  S  A  G  I  W  T  D  K  G
```

FIG. 11A(75)

```
87185  CCCGGATCCTGTGGATGGCCGACCGGCTGCGCGCCGGGGTGGTGTGGGCCAACACGTTCAACAAGTTCGACCCGACCTCGCCGTTCGGCGGG
       > S  R  I  L  W  M  A  D  R  L  R  A  G  V  V  W  A  N  T  F  N  K  F  D  P  T  S  P  F  G  G
87277  TACAAGGAGTCGGGCTACGGGTCGCGAGGGCGGCCACGGGCTGGAGGGGCGACGGGTACCTCGGTGTCGTGCGGTACGCAAGACGTAC
       > Y  K  E  S  G  Y  G  R  E  G  G  R  H  G  L  E  G  Y  L  G  V  .
87368  AAGCTCTTCATCGGCGGGGAAGTTCCCGCAGCGGTCGGGACGGTCGTATCCGTGCAATCGTGCGAACGTGTCGCTCCCGCAAG
                                                      > V  Q  S  A  N  V  S  L  A  S  R  K
87458  GACGCGCGGGACGCCGTGGTCGCCGCCGTGGCCCGCGCCGCGGTGAAGGGCTGGGCCGGGGCGACCGCGTACAACCGGGGTCAGATCCTCTACCGGGT
       > D  A  R  D  A  V  V  A  A  R  A  A  V  K  G  W  A  G  A  T  A  Y  N  R  G  Q  I  L  Y  R  V
87550  CGCCGAGATGCTGGAGGGGCGTCCGACAAGTCTCCCCCAGTTGTACGGTGTGCCGGCCGATGAGGTCGATCGCCGGGCCGTCTGGT
       > A  E  M  L  E  G  R  R  E  Q  F  V  A  L  G  V  P  A  D  E  V  D  A  A  I  D  R  W  V  W
87642  ACGCGGGCTGGTCCGACAAGCTCCCCCAGTTGTACGGTGTGGGGGCCAACCCTGTCGCCGGGCCGTACTTCAACCTGTCCGCCGAGCCGACG
       > Y  A  G  W  S  D  K  L  P  Q  V  Y  G  G  A  N  P  V  A  G  P  Y  F  N  L  S  A  P  E  P  T
87734  GGGGTGGTGGCCGTGGTGGCCGTGGCCGAGGCCCCCGCCCTGCTGGGTCTGGTCAGCGTGATCGCCCCGGCGATCGTCACCGGCAACACGGTGGT
       > G  V  V  A  V  V  A  P  E  A  P  A  L  L  G  L  V  S  V  I  A  P  A  I  V  T  G  N  T  V  V
87826  GGTGCCGCGGCCTGCCGACCAGCCCCTGGCCTCGGTGCCGACGCTGGCCGAGGTGCTGGCCACCTCCGACCTGCCGGGGTGGGGCGACGGTCGCTC
       > V  A  A  S  P  T  Q  P  L  A  S  V  T  L  A  E  V  L  A  T  S  D  L  P  G  G  V  V  N  V
87918  TGACCGGAGCTGCGATCACCGAGACGTCAGGGCGCGACGCGGAGAACCTCAAGCGGGTGATTCGGCCGGCCCCGGCCGACCACGACTGGTACGCCGACCCGGGCCT
       > L  T  G  A  I  T  E  T  V  P  T  L  A  A  H  L  D  V  N  A  I  D  L  T  G  V  G  F  A  S  L
88010  GCCACCGAGCTGGAGGTCAGGGCGCGCGCGGAGAACCTCAAGCGGGTGATTCGGCCGGCCCCGGCCGACCACGACTGGTACGCCGACCCGGGCCT
       > A  T  E  L  E  V  R  A  A  E  N  L  K  R  V  I  R  P  A  P  A  D  H  D  W  Y  A  D  P  G  L
88102  CACCCGGATGACGACGCTGCTGGAGACGAAGACGGTCTGGCACCCCAAGGGCGTCTGAGCCGTCCACCGACCCGCCAC
       > T  R  M  T  T  L  L  E  T  K  T  V  W  H  P  K  G  V  .
88193  CCGGCCGCCGGAGGCCAGGGGTGGGGCTCGGGGGCGGGGTGGATCTACTACGAGGGGTAGGAGGGGTGACTCGGTTGGGTGATCTTGAGC
```

FIG.11A(76)

```
88284 GGGCCGGTGATGGACGTGCTGTGGGACACCGTCCCGGGCACGTCGGACGGGGTGACGGTGCGCGAGGCCCTCGACGGCCGGA
      >  M  D  V  L  W  D  T  V  P  G  T  S  D  G  V  T  V  R  E  V  A  E  A  L  D  G  R  E
88375 GCTGGCGTACACGACGGTGATGACCGTGCTGGACCGGCTCGCCGGCAAGGGCATGGTGCGGCGGCAGCGGGAGGGCCGGGCCTGGCGCTACC
      >  L  A  Y  T  T  V  M  T  V  L  D  R  L  A  G  K  G  M  V  R  R  Q  R  E  G  R  A  Q  R  Y
88467 AGGCCGCGGCCAGCCGCGAGGCGCACATCGCCCAGTCATGCTCGACGCGCTGGACCTCGGCGGCAGCCGGGACGCCGCGCTGGTGCGCTTC
      >  Q  A  A  A  S  R  E  A  H  I  A  Q  L  M  L  D  A  L  D  L  G  G  S  R  D  A  A  L  V  R  F
88559 GCCCGGTCGGTGACCGGCACCGAGGCCGAGGTGCTGCGCGCCCTCGGCGCGCCGAGGCGGGGCCCGCTGACCGACCGCGTCGACGGCGCC
      >  A  R  S  V  T  G  T  E  A  E  V  L  R  A  A  L  G  A  E  A  G  G  P  L  T  D  R  V  D  A  P
88651 GCGCGCGACCGGGCCGGGCAGCCGGCCCTCGCCGACGAGGCGACGGACCGGTAGGGCCGTCATGGGCGTACGCGTCGACTTCGCCG
      >  R  A  D  R  A  G  Q  P  A  L  A  D  E  A  T  D  R  .                >  M  A  Y  A  V  H  F  A
88741 CGACGGTCCTGGCCTGCTACCTGACCGCTCAGGTCCTGGCCGCGTCGACGTGGCGCGGGCCCCCGGATCGTCTGCTGGCAG
      >  A  T  V  L  A  C  Y  L  T  A  Q  V  L  A  A  S  T  W  T  R  A  P  R  I  A  I  V  C  W  Q
88833 GCGGTCGGGCTCGCGCTCGGGCTCTCCGCCATGGGCCTGCCCATGGCGCTGGGCGTACGACCGGACCGGACCGGCAGGCGTTGCT
      >  A  V  G  L  A  L  G  L  S  A  M  G  L  P  M  A  L  G  V  A  A  Y  D  R  P  T  G  S  A  L  L
88925 CGCCCTGGCCACCGACGACCTGACCCACGGCACCCTGCCGGCCTCGCCGGGCTCCACCTCGGTCTGGTTCGGCATCGGGGG
      >  A  L  A  T  D  L  T  H  G  T  L  P  A  G  L  G  A  V  H  L  G  L  V  G  G  F  G  I  G
89017 CGGGCGCTGCTCGCCACGAGGTACGCAGCGTGCAGGCGACCGTCCAGGCGCAGCGACGGCAGCGTACTGCCGGGGTCAGCGC
      >  A  L  L  A  T  T  V  R  S  V  Q  A  T  V  R  A  Q  R  Q  H  R  D  L  L  A  L  V  A  R  R
89109 GACCCGGAGGTGCCGGGGGCGCTGGTGCTGGACCATCCGGCTGCCGAGCGGCGTACTGCGGGTCACCGAGAGCGCCACGCGC
      >  D  P  E  V  P  G  A  L  V  L  D  H  P  S  A  A  Y  C  L  P  G  V  R  P  R  V  V  S  A
89201 CGGGCGCTCAGCATGCTGGACCGAGCTGGCCGCCGTGCTGACCCACGAGCGGGCGCACGACCTTGTGCTGC
      >  G  A  L  S  M  L  D  R  A  E  L  A  A  V  L  T  H  E  R  A  H  A  Q  E  R  H  D  L  V  L
89293 TGCCGTTCACCGCCCTGTGCCGTGCCCTGCCCTGGTTCCGTTGGGTACGCGACGCGCACGAGCGGGTCGCCCTGCTGGTCGAGATGCGCGCC
      >  L  P  F  F  T  A  L  C  R  A  L  P  W  F  R  W  V  R  D  A  H  E  R  V  A  L  L  V  E  M  R  A
```

FIG. 11A(77)

```
89385 GACGACAAGGCCCGGGAGCTGCACGCGGAGGCTCCCCTGGCGGGGGCGCTTGCGCGGCGGGCGGCCACCGGATCGCGCGGCCGG
     >D D K A R E L H A E A P L A G A L R R G A A G H R I A P A G

89477 CACCCTCGGCCTGGGGCGACCGGGACCTGGACGTCCGGGATCTCAGCGGCTGGTCGCCGACCGCCCGGCTGATCGGGGCCGCCGCGC
     >T L G L G D R D L D V R V Q R L L V A D R P P R L I G A A A

89569 TGGGCGGTGGCGGTCACCCTGGTCGCTCTCCCTGAGCTCCTGAGCTCCGACCGTCCGACCCCGACACGCGCGAC
     >L A V A V T L V A L P V S L F L S .

89660 CGGACACGTCCGACCCGGACGCTCGCCGAGTTGGGACCCGAGTTGGGCCGGCTCGCCTGTTGCCGGGCACCGACATGCGGG
                                                        >M D Q L L L A R

89752 GCGATAGGTAGAGAGAGCCTACGTGTAGTCTTCCTACGACAAGGGAGAGCTACTACCGGAGGGCGGCATGGATCAACTGCTCCTCGCCCGTC

89842 TCCAGTTCGCCACGACCACCCTCGCTCCACTTCCTCTTCGTCGTTCTGGTCTGCTCTGGGCTCAGAGGGCTCTGG
     >L Q F A T T S L H F L F V V T L G L V T L L V G L Q T A W

89934 ACGATCACCGGCAATCCCGTCCACGAGCGCCTCGAACTGAGCGGCTGAACGTCTTCGGCGCGATCGCCACCGGCCT
     >T I T G N P V H E R L T R F W G Q L T V I N T V L G I A T G L

90026 GCTCATGGAGTTCCAGTTCGGGCTGAACTGGAGCGGCCTGTCGCGCTACGTCGGCAACGTCTTCGGCGCGATCGAGACCCTGG
     >L M E F Q F G L N W S G L S R Y V G N V F G A P L A I R T L

90118 TCGCGTTCTTCCTGGAGTCCACGTTCCTCGGGATGTGGATCTTCGGCATGGTGGCGAACGCGCTGGCTGCACCTCGCGCTGCTGTGGGGC
     >V A F F L E S T F L G M W I F G M V A N A L Q N P V G Y E V R D G V

90210 GTGGCGCTGACCGCCTACGCTTCGGCGTTCTGGATGGTGGCGAACGCGCTTGGGCCGTTCATGGTGGCGAACGCGCTTGGCCTTGCAGAACCCGGTTGGCTGCAGAACCCGGTTGGCTACGAGGTGCGCGACGGGGT
     >V A L T A Y A S A F W V M V A N A L Q N P V G Y E V R D G V

90302 GGCCCACCTGACCGACTTCGGCGCGGTGGCGGTGAGCGCGGTGGCGGCCCTGACCGGCACGCGGACGCGGACGCGCGCCCTGCTCACCGGCG
     >A H L T D F G A L L T N P T F G L A F G H V V A A L L T G

90394 GGATGCTGATGGCGGCGGTGAGCGCCGTGGCAGGCCTTCGCAGGCCTTGGTGCAGGCGCTTCGGCAGGCACCGCGCCAGACGCGCAGACGCGAGACGCCAGATCGGCCTGGTC
     >G M L M A A V S A W H L I R R T P D H A L F R T S L R I G L V

90486 ACCGGGGCGGTCTCGATCAGCCTGGTGCAGGGCTTCGGCAGGCAGCTGCGGGGCAGACGCAGCCCAGTTCGGCGGCCCAGTTCGGCGGCCAAGTTCGGCGGGGGG
     >T A A V S I S L V Q G F G F A Q F G P V G Q T Q P T K F G G G
```

FIG.11A(78)

```
90578 CGCGCAGGGCGACGCCCTGGTCGCGCCGAATGGACCTCCGGTTCGGGCTCCGTCTGGCCGACGTCGGGCTCGGTT
      > A Q R D A L V A E W T S R F G P G D Y T P P V L A D V G L G
90670 TCATGATCCTGATCGGCCTCCTCGGGCTGTCTGTTCATCCGGCTGCGCTTCCCGCTC
      >F M I L I L L G L W L L P L L W R D W F I R L R F P L
90762 TGGCTGATCCTGCTCGCCCTTCGTCGCGGTGATCCTCGGCTGGGCCGCCCAGCCCTGAGGTGGGCCGCAGCCCTGGGTCGCGTA
      >W L I L L A L P L F V A V I L G W I A R E V G R Q P W V A Y
90854 CGGGCTGCTTTCACCGAGCGCGGGCGGTCTCGCGCCGGGGTGATGCTCGCCTCGCTGATCGGCTTCACCCTGCTCCTGGGGGC
      > G L L S T E R A V S P V A P G V M L A S L I G F T L L L G G
90946 TCGCCGTGCGCCAACTGGGTGCTGTTCGCCCGGTACGCCCGGTAGCCCGATCCCGGCCGGCCTAGGCCCGGCCCAGCCGCCGAC
      >L A V A N W L F A R Y A A R G A A D P A L G R R P G P A A D
91038 GAGTCCCGTCCCGTCCCGGTCCTGAGGAGCCCCTGTGAACTCGCCTGGTACGCCCTGCTCGGGCTCTTCCTCGCCGGCTACC
      > V E L A W Y A L L G L F L A G Y
      >E S R P V P L G
91127 TGGTCCTCGGCGGCTACGACTACGGGCTCGGCCTGCTCGCCCGGCGGCCCGCGCGGCCCTCACCGCGGTGGGC
      >L V L G G Y D Y G V G L L L A R G G P P A R R A A L T A V G
91219 CCGTTCTTCCTGGGCAACGAGGTCTGGCTGGTCGCCACCGTCGGCATTCTGTTCGGCGCGCGTTCCCCACCCTGGAGGGGGAACTGCTGTCCGG
      >P F F L G N E V W L V A T V G I L F G A F P T L E G E L L S G
91311 CTTCTACCCCGTCGTCGCGGCCGCGCTGGCCGGTGATCATGTGACCGTCGGCGTGCAGCCGACGACGAGCCGACCC
      > F Y P V V A A A L A G V I M V T V G V Q L R S R P T D E P T
91403 GCGCCGCTGGGACCGGCATGGTGGCCGCCGGAGCCCTGCTCGCCGGGCTGCTCCAGGCGCGTACCG
      >R A A W D R M V A A G S L L A A F G W G A L L A G L L Q G V P
91495 CTGGCCGACGGCCACGTCACGGGCGTGGGCCACGTGGCCACGCCGTTCGCCGCCCTCGCCGGGGCTTCGGCGATGACGGCCCTGGTGGCCGT
      > L A A D G H V T G V G H V A T P F F A A L A G L A M T A L V A V
91587 GCACGGTGCGACGTTCCTCACGCTCCGGCTGTCGGCCGACGCCGACGCCGCCCCGCTCGCCCGGACCGCCCGGCGGCTCGTGGCGGTGGCGCTCG
      > H G A T F L T L R L S A A D A A P L A R T A R R L V A V A L
```

FIG.11A(79)

```
91679 CCGCCGTGCCCCTGGCCGCCCTGTCCGCGGGGCGCGCGGAGACGAGGCCCGCTGCCGGCCGTACTGCTGCCGTTG
     >A A V A L A A V A G A L S D R V R A A R Q R P L P A V L L P L
91771 GTACTGGTGGCGGCGCTGCTGGTCGCGGGGCTGGGCACCTGCCCGGGTGGCCTTCGCGGCGCTGGCGCT
     >V L V A A L L V A R A A H A R H L P G V A F A A T S A A L A L
91863 GCCGGTGGGCGGGAGTCGGCGGCGGGGCGTTGTGGCCTACGCGCTGGTCTCCACCGTCGCCCCGACGGCATCACTGAGCGTGACCGACGGGCGG
     > P V A G V G A A L W P Y A L V S T V A P T A S L S V T D A A
91955 CCAGCGGGCCGACGCTGACGGTGCTGGGCTGGCTGGCCCTACCGCTCCTGCCGGCCTTCCAGGCGATGTGCTGGTGGGTGTTC
     >A S G P T L T V L G W L A L P L L G F Q A M C W W V F
92047 CGGGGACGAACGGACAGGCACCGGTGACTGGTGAGCCGTCCCTTGACCCACGTCTGCTCCGCCGGCCCGGCG
     > R G R T D G R A P V Y W .
92138 CGACCTCGCCGGTGCTCCGGCGGTTGGCCCGGCCGCTCGCGGGCTALLLVVGQATALATVLAAA
     >V L A V L G G L T A L L V V G Q A T A L A T V L A A A
92229 CTCGACGGGCGGTTGGCCCGGCCGCTCGCGGGGCTCCGGTTTCCTGGCCGCCGTGGTGGGGCGGGGCGCTGGTCGCGGTGGGCCAGGGCACGGTGGC
     >L D G R L A R P A L A G F L A A V V G R A L V A W A Q G T V A
92321 GGCGCGGGACCCGCCGCGACGGTCAAGGCGGCGGCGCTGCGGGCCGACCTGCTCGCCGCGGCACGGTCCCGGCTGGGTCGCCGGGCAGC
     > A R A A A T V K A A L R A D L L A A V G R H G P G W V A G Q
92413 GGGGCCGGGCAGCTCGCCACCCTGGCCGGCCGGGGCCTGGACGCCCTGGACTACTTCACCGGGTACCTTCCGCAGCTCGTGCTCAGCGTC
     >R A G Q L A T L A G R G L D A L D A Y F T G Y L P Q L V L S V
92505 ACCGTCCCGGTGGCCCTGGCCCGTGCTGCGCAGGCGCGCAGGCGCGACCTTCGGCGCAGATCACCTTCGCCGACGCTGTGACGCTCGGCACTTCCTGACATGGTCG
     >T V P V A V L A R I T F A D W G S A V I V A L T L P L I P V F
92597 CGGGGCGCTGCTCGGCTGGCAGGCGCAGGCGGCCACCGAGCGCCAGTGGCGCCGTCGCCTGTCCACGCTGGGCGGCCACTTCCTCGACATGGTCG
     >G A L L G W Q A Q A A T E R Q W R R L S T L G G H F L D M V
92689 CCGGGCCTGCCCAGCCTGCGCCGTTCGGCCGGGCGCGTCGAGGTGGTCCGCCGGATGGCCGACGGGCACCGGGCGGCCACGATG
     >A G L P R L R A F G R A R G Q V E V V R R M A D G H R A A T M
```

FIG.11A(80)

```
92781 CGCACGCTGCGATCGCGTTCCTGTCGCGCTGGTCTGGAGCTGGTCGCCACCTGTCGGTGGGCTGGTCGCGGTGCCGGTGGGCATCCG
      > R  T  L  R  I  A  F  L  S  A  L  V  L  E  L  V  A  T  F  L  S  V  A  L  V  A  V  P  V  G  I  R
92873 GCTGCTCGGCGGCTGGCCTGTCCACCGCGCTGGTCGTGCTGCTGCTGCTGCTCACCCCGGAGGCGTACCTGCCGCTGCGGGCGGCCGGCAGCC
      > L  L  G  G  L  A  L  S  T  A  L  L  V  L  L  L  L  T  P  E  A  Y  L  P  L  R  A  A  G  S
92965 GGTTCCACGCCAGCATGGAGGGCCTGGCCGCGCTGGACGAGGCCACTCTCTCCGCCGACCCTACCGCCACCGCCGGGTCG
      > R  F  H  A  S  M  E  G  L  A  A  L  D  E  A  L  T  L  S  A  A  D  P  T  A  T  A  G  S
93057 CGGCCCGTCCCCGACGGCCGCGCCGAGATCGGTTCGAGGGCGTGACGGTGGCGTACGAGCGGACCGTGGCGCTACGGGACGTCACGCTGAC
      > R  P  V  P  D  G  R  A  E  I  P  F  E  G  V  T  V  A  Y  E  R  T  V  A  L  R  D  V  T  L  T
93149 AATCCGGCCCGGCGAGCGATCGTGGGGCCGGAGCCGGACCTGGCCGCGTCAGGTCGCGTGCCTGGGTGCCGACGGGCC
      > I  R  P  G  E  R  I  A  I  V  G  P  S  G  A  G  K  S  T  L  L  N  L  L  G  F  V  A  P
93241 CGCAGGGCCGGGTCACCGTGGGTGGCGTCGACCTGGCCGGCGCAGACCCGGACGGCTGGCGGCGTCAGGTCGCGTGGGTGCCGCAACGGGCC
      > T  Q  G  R  V  T  V  G  G  V  D  L  A  G  A  D  P  D  G  W  R  R  Q  V  A  W  V  P  Q  R  A
93333 CACCTCTTCGCCGCCTCGCTGACCGACAACATCCGGCTCGGTGCCCCGGGCACGCCCGGCACACCGTGCTCGGTGAGCGCGGCAGTGGCCGC
      > H  L  F  A  A  S  L  T  D  N  I  R  L  G  A  P  G  T  P  D  A  A  L  A  G  A  V  A  A  A  A
93425 GCTGGACGAGGTGGTCGCCGCGCTGCCCGGGACGGCCTCGCCGTGCTCGGTGGACACGGTGCTGGTGGGGCGAGCGGGGCACCTGAGCAGCGGCCAGCGGCAGCGGG
      > L  D  E  V  V  A  A  L  P  D  G  L  D  T  V  L  G  E  R  G  H  L  S  S  G  Q  R  Q  R
93517 TCGCCCTGGCCGGGCCGTTCCTGCGGGGACGCGCGACGAGCCGGCGGACACCGCGCGGCTGGACACCGCGAGCGAGGCCGGGGTG
      > V  A  L  A  R  A  F  L  R  D  A  P  V  V  L  L  D  E  P  T  A  R  L  D  T  A  S  E  A  G  V
93609 CTGGCCGCCACCGCCGCGCTCGTCGCGGGCCGGAACGCCCTGCTGGTGGCGGAACGCGCTCTTGTTGGTGGCGCAGGGGGTGCACCAGCGGGCCGCCGGATCCTGCG
      > L  A  A  T  R  R  L  V  A  G  R  T  A  L  L  V  A  H  R  P  A  L  L  S  D  A  D  R  I  L  R
93701 GGTCGAGGAAGGCGGGTCACCGAGCTGACCACCACCCCGGCCACAGGGGTGACCCCCGGCGAGCCGGCGAGCGGTGCCCTGCCGGACCGGCCGGGC
      > V  E  E  G  R  V  T  E  L  T  T  T  P  A  T  G  V  T  P  G  P  G  E  A  A  A  G  P  A  G
```

FIG.11A(81)

```
93793 AGGTCGCCCCGCCCGGCCGGAGAGGGGCGGGCCCGATGAGCACCGGTCCCGCCGACGACGCCTTCCGCCATCCCGCTGCCGGCCGACGGG
      >Q  V  A  P  A  P  A  G  E  G  A  A  R  .
                                   >M  S  T  G  P  A  D  D  A  F  A  I  P  L  O  A  D  G
93884 GCCCCGGTGGCCGGCGGCAGCGTCCGGGCCGAGCGCGTCCTGCGCCGGCTGGCTCCGCCGTACCTGGGCCGGCTGGTCGGCGCGGGTCT
      >A  P  V  A  G  G  S  V  R  A  A  E  R  A  V  L  R  L  A  R  P  Y  L  G  R  L  V  G  A  G  L
93976 GCTCGCCGCCGCCACCGAGTTCGCCGGGCTGGCCCTGATGGCCACCGCCACTGGCCTGCTGATGAGCGCCGCCGGTCGGCCACCACTGGACC
      >L  A  A  A  T  E  F  A  G  L  A  L  M  A  T  A  T  W  L  L  M  S  A  A  G  R  P  P  L  D
94068 GGCTCACCGTGGCGATCGTCGCGGGCGTCCGGGCGCTGGCGATCAGCCGAGGGCGTGTTCCGCTACACCGAGCGGCTACGAGGCCACGATGCCGTG
      >R  L  T  V  A  I  V  A  V  R  A  L  A  I  S  R  G  V  F  R  Y  T  E  R  L  A  G  H  D  A  V
94160 CTGCGGATGATCACCGACGTCCGGGCCGTGGCCAGGACCTGCTGCTGCGGGTGCTGCTCGCGGTGCCGGGTGCCCTGGCCCTGGTCGGCCCTGCAGCGGACGCGGCTGAG
      >L  R  M  I  T  D  V  R  A  G  V  F  A  A  L  A  A  R  R  D  A  A  R  Q  R  T  G  D  A  L  S
94252 CCGGCTCGTCGTCCGACGTGCAGGACGCGTGCAGGACCTGCTGCTGCGGGTGCTGCTGGGCGTGCTGGCCCTGCTGGTCGCCCACGGTGGTCAGCGTGTCAGCGTGCTGGCCG
      >R  L  V  S  D  V  E  A  V  Q  D  L  L  L  R  V  L  V  P  G  A  A  A  T  V  V  S  V  L  A
94344 TGGCCGGGGCCACCATCTCGCTCCCCGCCGGGTGCTGGCGCTGGGGCTGCTGGTGCCCTGCGTGTCGCCTGCCCTGGGGTGGCCTGCTGGCCTGGTCGCAGTCGGCGCGCCGACCT
      >V  A  G  A  T  T  I  S  L  P  A  A  G  V  L  A  L  G  L  L  L  V  A  G  V  A  L  P  L  A  A  T
94436 GCGCTGACCCGGCACGCCGGCGCACGCGTGGCCCCGGGTGGCCGGCTGGCGCTGGCCGCGCTGCGTGACGCGGTGCTGCACGGCGCCGCCGACCT
      >A  L  T  R  H  A  A  D  R  V  A  P  L  R  G  A  L  A  R  D  A  V  D  L  V  H  G  A  A  D  L
94528 GGCCGCGTTCGGTGCCGGGTACGGCCTGGACGCGCCCGCCGGCCGCCGCCGCCTGGAACGACGCGCTGCGAACGACGCTCGCCGCCACCG
      >A  A  F  G  A  T  G  Y  A  L  D  A  A  A  A  D  R  A  R  R  L  A  R  L  E  R  R  L  A  A  T
94620 GCTTCGCCGTGGACGCCGCGGGCGCTCGTCGCCGGGGCGCTGGTCGCCGGGGTGACGCGGTGGTCGTGGTCGTGACGGCCCTGCGCGACGGCGTCGGCGGGGTG
      >G  F  A  V  D  A  A  G  A  L  V  A  G  V  T  A  G  T  V  V  V  T  A  L  R  D  G  V  G  G  V
94712 CTGGTCGGGGTGCTGGCGGTCGGTTCCCTGGCCGCCGTCGAGGTGGCGCTGGCCGTGCTGGCCGCCGCCGCAGCCGGCAGCCGGCACCCAGCTCCGGGC
      >L  V  G  V  L  A  V  G  S  L  A  A  V  E  V  A  L  A  L  V  G  A  A  R  Q  R  T  R  L  F  A
94804 CGGGCTGGTCGGGGTGGCCGGTCGCCCCGACGCCCCGACGCCCCGCAGGCCGACGCCCCGGCCCGTGCCCCGGTGCCGCCGCCGTCG
      >G  L  V  R  V  A  A  L  L  T  A  P  Q  A  D  A  P  A  A  T  P  P  G  A  A  R  A  A  A  V
```

FIG.11A(82)

```
94896 GTGCCGGCCCGCACGACGTGCGCTTCGACGCGGTCACCGTGCGGTACCGGGCCCCGGCCACGGCCCCGGGTCACCCTGGACCTG
       >G  A  G  P  H  D  V  R  G  D  A  V  T  V  R  Y  R  A  G  T  A  P  A  L  D  R  V  T  L  D  L
94988 CCGGCCGGCCGCCGGGTCGCCGTGGTCGGGCCCGAGCGGGCCGGCAAGAGCACCCTCGCCGCCGTCTTCACCGGCACGGTTGCGACCCGAGCA
       >P  A  G  R  R  V  A  V  V  G  P  S  G  A  G  K  S  T  L  A  A  V  L  T  G  T  V  R  P  E  Q
95080 GGGCCGGGTCACCCTCGACGGGGCCGACCTGTCGGCGTACCCGGTTGAGGAACTGCCCCGGGCCGTCGGGGCCGTGCTCGCCGAGGCGTACG
       >G  R  V  T  L  D  G  A  D  L  S  A  Y  P  V  E  E  L  P  R  A  V  G  G  L  L  A  E  A  Y
95172 TCTTCCACGCCACGGTCCGGGAGAACCTGCTGCTCGGCCGGCCCGCCGCCGACGAGGCGGAGCTGACCGCCGCCGGGACCCGGGCCGGCCTG
       >V  F  H  A  T  V  R  E  N  L  L  L  G  R  P  A  A  D  E  A  E  L  T  A  A  T  R  A  A  G  L
95264 CTGGACTGGGTCCACGCCCAGCCCGGCTGGAACGACACCGTGGTCGGCGAGGAGGGGCAGCTCTCCGGGCCAGCGCCAGGCCTCGC
       >L  D  W  V  H  A  Q  P  A  G  W  D  T  V  V  G  E  E  G  Q  L  S  G  G  Q  R  Q  R  L  A
95356 GCTGGGCCCGGCGCTCGCCGCGGCCCCGACCCCCGGGCACCTGCTGGTCGACGAGCCGACCGAGGGCCTCGACGACCCGTCGCCGGTGCTCG
       >L  A  R  A  L  L  A  A  P  G  V  L  V  L  D  E  P  T  E  G  L  D  P  S  A  A  D  A  V  L
95448 CCTCGCGGCACTGGCGGCCGACCCCGCGGGCACTCAGCGACGGCTCAGCGGGCTCGCCGACCTCGACGAGATCGTGGTG
       >A  S  A  L  A  A  T  P  A  G  H  S  V  L  L  I  S  H  R  L  S  G  L  A  D  L  D  E  I  V  V
95540 CTCGACGCCGGGCTGGTCGCAGCTGCCGGGGGACCGGCGTGGTACCGGGACCAGTGGCTGCTCCAGGAGGC
       >L  D  A  G  R  V  V  Q  E  G  R  H  D  E  L  V  A  A  P  G  W  Y  R  D  Q  W  L  L  Q  E  A
95632 GGCCGAGCGCGGGTACCTGGCCCTGACGCCGCGCCCCGAGCCGGCCGTCGGCAGTCACCGCATGGCAGGCT
       >A  E  R  G  Y  L  A  L  T  P  R  P  .
95723 CGTCGCATGGTCGCGCTGCGACGACGTACTCGTGAAGGAGCGGCTGCGCGAGTTGAGCGACCGGCTGCACGGCCCGGCTCAAGGCCG
       >M  V  R  C  D  D  V  L  V  K  E  R  L  R  E  L  S  D  R  L  H  G  P  A  R  L  K  A
95814 ACCTGCTGGCCGAGGCCCGCCACGCGTTGCAGGACGCCGTCGAGGCGTACCGCGACGGGGGCTGCCGGCGGCGGAGGCGAGCGGCGGGGCA
       >D  L  L  A  E  A  R  H  A  L  Q  D  A  V  E  A  Y  R  D  G  G  L  P  A  A  E  E  R  R  A
95906 GTGGCCGAGTTCGGCGAGCCGGCCCGGCTCGCCCCGGCGTACCAGGCGGAGCTGGCGGCCGGGAGCCTGCGCGGGCTGTCCCTGTCGCGGGTGCT
       >V  A  E  F  G  E  P  A  R  L  A  P  A  Y  Q  A  E  L  A  A  G  S  L  R  G  L  S  L  R  V  L
```

FIG. 11A(83)

```
95998 CGCGGTCGCCGGCGTCCTGGTCGTCGCGGGGGATCTGACCTGGCAGGGGTCGAGCTGGAGCGGCGGGCCCCCGGCCGGGCCTACCGCC
      > A V A G V L V V A G D L T W Q G S S W S G G P P A A Y R
96090 TGCTGTCCGGCTCGGTGGACGGCATCTGGCTGGGCGCGGTTGTCGTCGGTGGCGGGGTTGCTGTCGGTGGCGCCTCCGGTGGGCG
      > L L S A S V D G I W L G A V V L S V A G L L L V A A S A R W A
96182 CACCCGGCCTGCCCCGCCTCCTCGGGCTCGGGCTCGTCGTGCTGGGGGTCGTGCTGGTGGCGGGGCCCTGTACGC
      > H P A L P R L A R L T G L T A T L V L G V A T G A A L Y A
96274 CTGGTCGATCGGCTCTGGGAGGCGGCCCGCACCTGGCCGCCGATGCTCGTGGGCGCGCTCGTGTGCGGCGCGGGGTTCTTCTGGATCGGTC
      > W S I G L W E A A R T W P P M L V G A L V C G A G F F W I G
marker                                                                                  junction
96366 GGGCGGCCCGGTCCTGCTGCTCTCGGCACGCCGACCGGCGTAGTCGGGTGGGCGGGCGCGGTCAGGCCGGCGTGGCGG
      > R A A R S W L L S A R R P A G P A .            < . A P T A P
96457 GGGTGTCGCCGAGGAACTGGCCGACGTCGCGCTGAACTCCCGGCCGGCGTTCCCGGCGGCCGGAGTCGGTCAGC
      < T D G L F Q G V T A S F E R W G A R E G A L A R R G S D T L
96549 TCGTAGGTGCGCTCGCGGCTCCAACTGTGCTGGTGCACCACGTGCCCGGCGCTCCAGCGGCCGTGCCCCGTTCCAGCACGCGA
      < E Y T R R E R G N V T S W S S V V H G A R E L R R L A P Y I T
96641 CCCGGTAGGCAGATCGAGGCTGCCCTCGCTGTCCGAGGTGTCCGGAGGCCTGGGCCTTCATAGGTAGCAGGTCACTCGCGCCGCACGCGG
      < G T P L D L S G E S R A R L A E I I A Y G H L A G R E L V A L
96733 GCAGCAGCGGGTCCTCCTAAGCCGCCCACTAGGTATGTGCCCAGAGTCACTCGGCGCCCGGGTGGGCAGCCCGAAGCACAC
      < L L A D L H G H L A Q A K M                     > V G S P K H T
96824 GCACCGGCCTCCTAAGCCGCCCACTAGGTATGTGCCCAGAGTCACTCGGCGCCCGGGTGGGCAGCCCGAAGCACAC
96914 GGAGGTCAGCGTGGCCGTCCGCCAGTCGCCCCAACGCCGCCGACGCCGACGAGACCGAGCCTGAGCTCGACGAGGACCGGACCGGAAG
      > E V S V A R Q S P Q R P D A D E P E L D E T D G T A A E V E
```

FIG.11A(84)

```
97006 AGGACGGCGCGCCCGTCGGCGCAGGAGGACGCCGACCGCGCGCTCTGGGACGAGCTGCGCATCGACCCGGTCGAGATCGCCCTGCCGCCGGC
      >E  D  G  A  R  P  S  A  Q  D  A  D  R  A  L  W  D  E  L  R  I  D  P  V  E  I  A  L  P  A  G
97098 ACCGGCTACACGCTGCGGGCGTACCGCCCGGCAGTTGACCCCGACGGCGAGCGGCGACCAGGACGACCCGTTCCTGGCCCG
      >T  G  Y  T  L  R  A  Y  R  P  A  R  E  L  T  P  T  D  V  A  E  R  D  Q  D  D  P  F  L  A  R
97190 CCGGCAGGCGGTCGAGACCGACGAGGACGAGGAGGTCATCATCCTCGACGAGGAGGTGGCCGCCGAGTTCGCGGAGGCGGACGCGGAGG
      >  R  Q  A  V  E  T  D  E  D  E  D  E  E  V  I  I  L  D  E  E  V  A  A  E  F  A  E  A  D  A  E
97282 AGGCCGGCGGGAAGTCCCGCTCCCGCAAGCCCCGCGACTGCCGAGCGCCGAGCCGCCACAGACGCGGAGACGGAGGAGGAG
      >E  A  G  G  K  S  R  S  R  K  P  R  A  D  S  D  D  A  G  A  A  T  D  A  D  A  E  E  E
97374 CCGGACTCCGACGAGGACGAGGCGGGCGACGAGGAGGTTCCGGTCTTCCTCAGCCACCGGGGCAGGCTGCTGCTGTTCAAGACGCCGAATC
      >  P  D  S  D  E  D  E  A  G  D  E  E  V  P  V  F  L  S  H  R  G  R  L  L  L  F  K  T  P  E  S
97466 CCTCGTCAGCTTCGTCCGACGAGGACACCTACGAGCTGGAACTGTCCAACGGTGGAGCCGGCCGACA
      >  L  V  S  F  V  R  S  G  A  P  N  D  M  S  Q  L  D  S  W  N  E  L  S  E  R  V  E  P  A  D
97558 TCGTCCCGACGAGGACACCTACGAGCTGGAACTGTCCAACGGTGGAGCCGGCCGACACCTGCGGCTGCTGATC
      >I  V  P  L  D  E  D  T  Y  E  L  D  L  V  V  E  N  L  R  G  G  H  D  T  W  D  S  A  L  L  I
97650 GAGCCGGCCGAGGTGGCCCGGACGTCGCGGACGTCGCGTATGCCCTGCGTGTTGGACATGCTCTCCGCGGCTCCAGCTCGACGACCTG
      >E  P  A  R  W  P  G  T  S  R  M  P  C  V  C  P  P  C  W  T  C  S  P  P  A  P  S  T  T  W
97742 GACGAGGGCGCTGCGCGTCGGCGCCACGGCCAACGGCCTCGGGGGCTTCCTGCGCGCTGAGGAAAATCGGGCGCGAGACGGCGAGTC
      >  T  R  R  C  A  P  R  P  T  A  G  S  G  A  S  S  A  A  G  G  .
97833 TCGGTTGGCGCACCATTGTCGCAAGATCTCTGCGGTCGTGGACTGCGCGACACGTTCCAGGGAGCATCAGTCTCTGGACAGAGAAAG
                                                              BamHI
                                                           junction marker 97925 ACCAGTCCCGGGAGGAGGAGGACGCTCGTGGCCGCTCGTGCGCCTGTACTGCGGATCCGGCCTCGGCCGTGCCGACGACCGGCCTCGGCC
98017 GGTTCGGCGCTCGACGTCGCCGCTGTGGTCGCAGGTCGGCTGCGACGACGCAGGTCGGCGACGCCAGCCGGCTACGCTCAGCT
98109 GGTCGTGCTACTCGTGGAGCGGCCGGAGCCGGACGAGCCACCACGGTCACCTCGCTGCTGAGTG
```

FIG.11A(85)

```
98201 CCGCCGGGGCGTCCACTGGGCGATCGGGGACGACGACTCGGTGGACGACTTCGCCGAGCGGTTCGCCGACGACTCGCTGGAGGAGATGCA
                                                                                  > M  Q
98292 GTCCGCGCGGCCGAGCGGGCGGTGGGCCTGGCCCGGGCGCTCCAGGCGGGCGCTCTCGGCGGTCACCCTCCCGGCGCGTACCCTGCCGAG
      > S  A  P  A  E  R  R  A  V  G  L  A  R  A  L  Q  A  G  A  L  S  A  V  T  L  P  A  P  R  D
98384 TCGCCGGCTACAAGCAGGTCCTCTCGGCGCACGCGGCCCTCGCCAGCGGCCACTCCGCCGTGGCGCTGCGCGAGGTGCTGCGGGAG
      > L  A  G  Y  K  Q  V  L  S  A  H  A  A  L  A  S  G  R  H  S  A  A  V  A  L  R  E  V  L  R  E
98476 CTCTACCCGGCCGCCCTGCGCGCCTACCCGGACCCCGAGCCGGTCGCCCTGGCCGTGTTGGACGCCCTGCCCGAGCCCGGGATGCTGGG
      > L  Y  P  A  A  L  R  A  Y  P  D  P  A  E  P  V  A  L  A  V  L  D  A  L  P  E  P  G  M  L  G
98568 CGGGACGATCGCCCGGGGCCGGGAGCGGGAGGTGTCGGTCGCCATCGCCGAGACGCCATCGCCGGACGCGGTGGCCGACGAAGGCAAGA
      > G  T  I  A  R  G  R  E  V  S  V  A  A  D  A  I  A  A  H  L  A  A  D  G  V  A  D  E  G  K
98660 TCAACGATGCGGTGACCGCGCTCAGGGTCGCCATCGCCGAGACCCCCGCGGCGGCGGTCAGCCGGGCGCTCACCTCCGCGGTGGCGGAG
      > I  N  D  A  V  T  A  L  R  V  A  I  A  E  T  P  R  R  A  A  V  S  R  A  L  T  S  A  V  A  E
98752 ACGGTCCGTCAGGCGGTGGCCTCGGTGCGAGCATGCGACGCGGGCTGCGAGGCCCTGGTCGGCGCGCTCGACGCCCGGGTCACCACCCCAG
      > T  V  R  Q  A  V  A  S  V  R  A  C  D  A  G  C  E  A  L  V  G  A  L  D  A  R  V  T  P  T
98844 CCCGGTGCCGGGCCGGGCGGGGAAGGGCGAGCCGGTCGCCGAGTTGCCGGGCCTGCCACTGCGGGCCCACAGAGC
      > P  V  P  G  R  R  A  A  R  G  E  P  V  A  E  L  P  G  A  G  L  R  A  L  R  P  T  E
98936 CCGAGCCGGTCCCCGGCGGGCAGCCGTCCCAGCCGGTCTCCCGGCCGTCCCGGCGGCCCCGTCTCGCC
      > P  E  P  V  P  G  R  R  S  R  P  E  P  V  P  G  G  S  L  P  A  Q  P  R  P  L  G  P  P  P  V
99028 GCGCCGGAGCCGGTCGCCCCGCCGGTCGCCCCGCGGCCAACCGGCCGGCTCCGCCACCCGCCGCGGCCAGCATCACCCCGGGGATCACCCCGGGAGATCACCCGGGGATCACCCCGATCGCGCCGAGCC
      > A  P  E  P  V  A  P  P  P  V  A  P  R  P  I  T  P  A  A  S  A  T  P  P  V  S  G  P  P  S  P
99120 CGAGCCGGCGCCTGATCGACAACCGGCCAACCGGCCGAGCCGGAGCCGGTCGTTCCGGCCACGCTGACACCGCCACGCTGACCGCTGAAGACGCTGACCGCGAGAACGCGGGGCCGAGCC
      > E  P  R  R  L  I  D  N  P  A  N  R  P  V  S  A  P  P  P  P  P  G  I  T  P  I  A  P  S
99212 AGCGCGAGCGGAGCGTCCGTGCCGCCGGCCGAGGCCGGTGAGCCGTTCCGGCCACGCTGACACCGCCACGCTGACCAGAACGCGGCGGGAG
      > Q  R  E  R  G  S  V  P  P  A  E  E  A  G  E  P  F  R  P  T  L  T  T  A  A  I  Q  N  A  R  A  E
```

FIG. 11A(86)

```
99304 CGGCAGCGCACCATCATCCGCCTCGCCCCAAGACGACGGGCGAGTCCGCCGCGCCGCCCACCGGCGGCTTCAGCGCCACCGACCTGAGCGT
      >R Q R T I I P P R P K T T G E S A P P P T G G F S A T D L S V
99396 CCCGGTGCCGACCCCGCGTCCCGGCCAGGAGTCCGCTCCCCCGGGCTCGGGGGCGAACTGGCCGCTGGTCAACAACCCGGAGGACCCCGCCG
      >P V P T P R P G Q E S A P P G S R A N W P L V N N P E D P A
99488 ACAGCTCCCCGAACAATCCCGTCGCGCGGCGCCCTTGGAGGATCGGGCAGATCGACGCGCCGACCCAGGTGGTCCCGCCGGCC
      >D S S P N N P V A R R P L E D R A K R Q I D A P T Q V V P P A
99580 GAGGGCCGGGTCACCCCGCCCTGGCTCGCCGACGACCTGCCCCAGGAGCCACCGATGCTGCGCCTGGTCGAGCCGCCACCGCTGGCCGACCG
      >E G R V T P P W L A D D L P Q R P P M L R L V E P P L A D R
99672 GGCACTGCGGGATGGGCCGGGCCAGGCTGCCGACCCGCGTCTGGAGCCCCCGCCGCTGCGCCTGGTCGACAGCGGCGAGGCGCAGCCCGCCG
      >A L R D G P G Q A A D P R L E P P P L R L V D R G E A A R A
99764 GCCGTCCGCGCCGAGCCCCGCCCCGAGCGCGGGGCCCCGGCCGAGCACCGTCTCCGCGTCGGGTCAGCGGGTCCGTTGGAGGAGCGGCCCGAC
      >G R P A P E P R P E R A P A E H R S P L G Q R V P L E E R P D
99856 ATGGAACATCGGACCGCCCCGCCAAGTCGGCCTGTTCGTCGGGCACGGCGACGAGTCCGAGATGGACTGGTCGAGCACCGCCGACACCGGGTGGC
      >M E H R T A P P Q P S R S A P M E R R T P P I S D E G D G D L
99948 GCTGATCTTCGCCGCCGCCAAGTCGGCCTGGTTCGTCGGGCACGGCGACGAGTCCGAGATGGACTGGTCGAGCACCGCCGACACCGGGTGGC
      >L I F A A K S A W F V G H G D E S E M D W S S T A S T G W
100040 AGGCCGGCCGAGCAGGCCGGCCCGGCGGTGGGCGCCGATACCAAGGCCGGTTGCCCAAGCGGGTGCCAACCTGGTTCCGGGC
       >Q A A E Q A A R P A V G A D T K A G L P K R V P Q A N L V P G
100132 TCCCCCCTGCGCGAGGAGATCGGCGGGTTCGCCGTCGGCGGCCGTCCCGGCTACCGGCTCCTGACCGGGACTTCACCCGGGACACCGGGACCGAG
       >S P L R E E R P L R I V R D A A S L A E N T T G Y F R G W R R
100224 CGGGCAGGAGATCGGCGGGTTCGCCGTCGGCGGCCGTCCCGGCTACCGGCTCCTGACCGGGACTTCACCCGGGACACCGGGACCGAG
       >G Q E I G G F A V G G R R P G R E A A G G W D F T R D T G D R
100316 ACGACGACGGGAGTACGAGTACGAGCGCCCACCCGACGACCCACACCGGTGGGACCACACCGAAGAGACAACCCTGGCCGGCGGCCTGACGTC
       >D D D R E Y E Y R S A G Y R S .
100407 CCGTGCTGCGGCCGTAGCAACCCGACCGCGTAGCAACCCGACCACACCGGTGGGACCACACCGAAGAGACAACCCTGGCCGGCGGCCTGACGTC
```

FIG.11A(87)

```
100499  CCGCAGGGACGGTGACGGCTACTGGCCGTCCCCCCGGGAAGGTTGCGAGGCGGTCGGGGCGCACAGGCGCTGTCAGGGCCGCTCCTGAGCCG
100591  CCCTACGGAATGGGCTAGCCCTACGGAATCGAGCGCCGGCCGGTTGCCTTCGAGTTCGCCGCCGGTGTCGAGTTCGCCGTCCCAAACAGCGGAC
100683  GCGCCCGACGGCCCGGCGGGTGCCGGTGCGGTCGTCCGTCGTCGATCAGGCGCGCGATCAGGCGCGCGAGCGGCGCATCGTGAGCA
                                              < ·   A  P  A  V  A  R  S  R  R  M  T  L  V
100774  CGTACTCGACACAGCGGAGATCAGCACGTGCTTCGACTCCCGGTTCCGGGCGTCGCAGGCCACCGGCCACGGTCGTGCCGAGATCGGCAGC
          < Y  E  V  L  S  I  L  V  H  K  T  S  E  R  N  R  A  D  C  A  V  V  P  V  D  H  S  I  A  L
100866  GCGTCCCGGACGTCCTGCGGGTCGTGGTAGCCATCCGTCGAAGCAGTTGATGGCCACCAGGTACGGCCAGCCGGATGCTCGAAGAAGTC
          <A  D  R  V  D  Q  P  D  H  Y  Q  M  G  D  F  C  N  I  A  V  L  Y  P  L  R  R  H  E  F  F  D
100958  GATGGCCGGCAAGCAGTCGGCCGCGCTCGGGCGTGTCGACAGGACGCACCGGCCATGGCCGCCGTCGTCCCACATGAACCAGA
          <I  A  A  F  C  D  A  L  R  R  T  D  V  L  V  V  A  G  I  A  G  R  C  L  E  D  W  M  F  W  F
101050  ACCGGGTCTGGCCGGGTGCCGAACAGGTACAGGGATCAGGTCCCGGTCGATCGGAAGTCCATCGCCGAAGTCCACCGTGGTCGTC
          < R  T  Q  G  P  T  G  F  L  Y  L  I  L  D  R  D  I  S  I  R  G  F  D  M  A  V  T  T  T
101142  TCGCCCGGCACTGCGGGGTCGTGCCGGGGTGTCGTGGATCGCCTCGGTTGTCAGGGCGTGATCTCCGAGACCGAGCC
          <E  G  P  V  Q  R  T  D  D  V  G  V  G  A  S  T  M  I  A  E  T  T  L  P  T  I  E  S  V  S  G
101234  GACCAGGCGGTCGTTGCCGCCGGCGAAGTCGATAACGCCACCACCGGCGATAACGATCTTCGCCGACGTCACGCGCGGGGTGCGACA
          < V  L  T  T  K  G  V  G  F  G  G  A  I  V  I  K  A  S  T  V  R  G  S  P  V  P  P  R  H  S  M
101326  TGTCAGAGCCTGCGAAGTCCACTCAGCAGTCTTCCAGCAGTGATGAGCACGCCAGCTGCATCCGCGCCGATCTCGGCAAGCGAC
          < ·  L  R  R  L  G  S  L  V  R  E  L  L  E  T  G  V  A  D  D  S  D  D  L  I  T  P  E  H  V
101417  CTGCGACGCGTCCGTCCGACCGGCCGTCCGTCGGCGATGAGCACCGTTGACCGGAAGCTGCATCCGCGCCGATCTCGGCAAGCGAC
          < A  V  L  G  D  T  A  M  D  A  I  L  V  R  A  V  G  L  P  L  Q  M  R  A  A  I  E  A  L  S
101509  TGCACGCGTCCGTCGCACAGCCGGCGATGTACTGGTGCTCTCGGCGTTGCTACTGGCAGGCCGGTGCTGCTACTGGCAGCGGTTACGGCCACGTCGT
          < Q  V  R  G  D  C  L  A  A  I  Y  Q  H  E  R  G  Q  G  G  N  S  S  A  A  A  R  G  R  V  T  T
101601  CTCGAGCGCCTCCAACGCGATCGACCTGCGTCCAGCCGAGCGGCGCACCGCCGAGACCGTCGCCTACCCGCGTCGTGCTGGGTACGGCCAGTCGGCTCGT
          < E  V  L  A  E  L  A  I  D  L  R  P  R  T  R  G  R  T  V  A  Y  P  R  V  L  A  G  T  P  E  D
```

FIG.11A(88)

```
101693  CACGATCCATGTCGCCGCTCACCTCCTTCGTCCCGACACCGGCTGAACCGGTGGAACCCGTGTTCTTGTCCTTGCCACCCGCCCGAC
         < R  D  M  D  G  S  V  E  K  T  G  S  V
101784  CCATCGGCCAGCGCGTGGGTCAGCCCCATCATCCCCACAGTCGTACGGCTGCGGGGTCAACGCGTCGCCCACCGGTCGACCAGGAGGGC
         <·  G  M  M  G  V  T  T  R  P  Q  P  T  L  A  D  G  V  R  D  V  L  L  A
101875  CATCTCGTATCGACCTGCCCGACGTCGCAGCTGCGAGCGCGGCAGCGAGCACGGGCAAGGACGAGCCGTCCGAGATGGAACATCAGGAACAGGAAGC
         < M  E  Y  G  V  Q  G  V  D  C  S  R  A  A  L  V  A  F  S  S  G  D  S  I  S  M  L  F  G
101967  CGTTGTCCATCTCGACACCGGTCTGCAGCGGGAGCTGGTCGGCCCGGTCGAGCACCGTGCCGCTCCCTGCGTGAGGCTGACCAGCCGGCTGAGGCGACGCGATC
         < N  D  M  E  V  V  T  Q  L  V  A  G  G  E  F  C  R  A  A  G  Q  T  L  S  V  L  G  S  A  I
102059  GCGGCGAGCTGGTCGGCCCGGTCGGGCGAGAAGGTCTCGTGACGACGCAGGAGCAGAGCCGGCCAGGCAGAGACGCAGGAGACCGTGCCGGCGACACC
         < A  L  Q  D  A  R  D  R  P  L  D  R  S  S  A  L  L  L  G  D  A  S  V  A  V  A  H  A  V  G
102151  GGGCACCCGGTCGGGCAAGTTGGCCAGCAGCCGGAAGATCCTGCGTAGTTGTCATCCTTGCTCCTTCTGCCGCTCCGGCCACCCG
         <·  G  Q  Q  E  K  Q  G  S  G  A  V  P
102242  GGGCCTGAGCTGAGCCAGAGACTGCTGCCCACCCGGAGCTGCCTCCGGGTTGGTCGGTCGCCGTCGGTACGCCGACCTGCTGCACG
         < P  V  . G  S  G  S  S  Q  Q  G  P  A  A  E  P  N  T  P  N  G  D  P  E  T  R  G  R  Q  V
102334  CCTCGATGGTATGCCGAGACAGACCGCGACGCCCTCCGGCGACGTACGGCGCTGGACGACGTGGTGGGCTTCTCACCCGCCAGGCACGAG
         < G  R  H  Y  A  S  L  L  G  R  V  G  E  P  T  R  R  Q  V  S  T  T  P  K  E  V  G  G  P  V  L
102426  TTGGGCCATCGGCACCGACTTCGGCCAGCCCTTGCGGTGCTGTCTCCGCGGGACCTCGGTGGCCGCGAGCGCGGCCGCAGCGCGTCGT
         < Q  A  M  P  V  R  K  P  L  G  K  R  T  T  E  A  V  P  V  E  T  A  A  S  A  A  R  W  S  P  P
102518  CCGCGGCAGTCTGCGCGGCCAGGCGTGGGCCCTGCGGCGTGGCGTGGCAGCCCTGGCGAAGCCCTGGGGGAACCCGGGGTGCCACCGTTGTTCGGC
         < A  A  T  Q  W  A  H  A  Q  P  T  P  R  R  G  A  F  G  E  A  P  G  P  R  T  G  G  N  T  P
102610  GACCCGTTGTCGCGACGCGGGGAGAAACTGTTGGGTCACGGCGTTCGCCGGCGTCCCGGCGCTCCCGGCGTTGGGTCGTGTCTGGACGGGCCG
         < S  G  N  D  R  P  M  G  G  A  M  P  R  D  A  M  P  A  N  G  T  T  G  P  A  P  T  Q  V  P  R
102702  GCCGGTGACGTCGACGTCGCGGGCAGCTTCCAGCAGACGGTCGCCGCCAACGCACCGCTCCGGCGGCGCCGGGTGTCGGGCGACGCCGGCCG
         < G  T  V  D  V  A  S  F  Q  Q  T  V  A  A  N  A  P  S  G  A  G  N  T  A  R  Q  A  V  G  A  T
```

FIG. 11A(89)

```
102794 TCTCCTCCGAACCCGAGGCGGGGTACGGGAACCAGGCCGACTCGAGCTCCCGGAAGATCGGAGCTCCATCGTCTCGTCCGGTACCGCTGC
         E  E  S  G  S  R  R  T  R  G  W  A  S  E  L  E  R  G  I  P  L  E  M  T  E  D  A  Y  R  Q
102886 TGCCGGTTCTGGGCCTGCACGGGCGTCGACGCGCCGGCGGTCGTCGGCCGGTGCTCGGCCGTGCTCGGCCACCTCGGTGCTCGG
         Q  R  N  Q  A  Q  V  P  T  S  R  A  P  T  P  P  T  T  P  Q  T  A  P  T  S  P  V  E  T  S  P
102978 CACCCGGGGCAGCTCCGTGGTCATGTCCAGGGCGCTGCGGCGAGGCGCTCCGGCACCGGCGTGACCGGCTCCGGCGCGCACCGGCGCC
         V  R  P  L  E  T  T  M  D  L  A  A  A  L  R  E  P  V  P  P  T  V  P  E  P  A  A  V  P  P  W
103070 AGGCCGGCGGCGCCTGGGCGCACGGGGACGCGCTGGGACGCCAGCAGCTGGGACTGGGCCGAGTACGGCTGACCGGAACACGGCGTGCCG
         A  P  P  A  V  P  A  Q  A  D  P  V  P  R  S  P  L  P  Q  A  S  Y  P  Q  G  S  V  P  T  G
103162 AACGGCTGACCGGAGACGGGACGCGCTGCCGAACGGCTGGCGGACACCGGGCTGACCCGAGACCCGAGACGGCTGACCCGAGACCCGAGAAGACGGAAACGG
         F  P  Q  G  S  V  P  T  G  F  P  Q  G  S  V  P  A  A  S  V  P  Q  G  S  V  P  F  V  S  V  P
103254 CGGTGCCGACACCGGCGCGCACCGAGACGGGGTGCCGGACACCGGTGCCCGGACACCGGTGCCCGGACACCGGTGCCCGGACACCGGCGGCCGGCTGCT
         P  A  S  V  P  P  V  S  V  P  P  P  T  W  G  R  A  E  P  S  S  P  L  Q  R  P  I  A  P  Q  Q
103346 GGCCGCTGCTGCCGGATCGCGTCGCCGGATCGCGTCGCCGGATCGCGTCGCCGGATCGCGTCGCCGGATCGCGTCGCCGGCGGCGCGCA
         G  S  S  A  P  D  G  D  G  S  A  R  R  Q  P  L  P  D  S  S  Q  G  N  S  T  R  G  A  A  A
103438 CCGCCAGCGGTGCCACTGGCCCCGGTCAGTTCCGACGCCGCAGTCCGACGCCATGGAACCGGTCGACGCGGGCGTGCCGTTGCCGTTGCG
         G  A  T  G  S  A  G  T  L  D  S  W  A  P  M  S  R  M  S  G  T  S  A  P  T  G  H  G  N  R
103530 CGAGGCCGGGTCGAACGACGGCCGGCCCGGTTACCTGGTTGCCCGAGTGCCCGGCTGGGTGCCGGTGTGTCGCCGGGTTGTTGC
         S  A  P  D  G  D  R  G  G  L  T  V  Q  N  G  S  H  G  P  R  Q  T  P  A  P  T  A  P  N  N  G
103622 CGAAGGCCGCGAAGGCCACCCAGGGCCGGAAGGCCGGAAGGCCTGGTGAGCCGACGGTGACGTCGGCAGGGTGACGTCGGCGACGTCGGCGACGTCGG
         F  A  A  F  A  G  L  A  P  P  A  G  G  P  Q  S  S  T  L  S  A  P  P  A  P  L  A  G  P  Q
103714 TGGAACCGGCTCCGGAGAGCCGGAGAGCCGGACGCCGGACGCCGGACGCCGGTCGGTGACGTCGCCGGACCGGGCCCGGTCGGTCGGGCCGGAGCCGGTCGG
         Q  F  R  G  S  L  A  R  P  V  L  V  T  T  P  L  T  V  D  A  V  T  G  R  D  T  G  P  R  L  E
103806 GACCTTGACCGCCGTGCCGGGACGCGACCACCAGCGCCAACCAGGCCGACCCCATCATCCGGAGACGGCCACGTCCACTGCGGGCGGCCGAGGCGA
         V  K  V  G  H  R  S  A  L  R  A  V  V  V  L  G  M  M  R  S  V  A  V  D  V  Q  P  P  S  A  L
```

FIG.11A(90)

```
103898  GGCGGTCGTTGAGGTCGTGTAGCTGCTCGGGCTGATGCCCGGTCCTCGAGCGTAGAGGTTGGCCCGGTCGGCGACCGGCGGGCC
        < R  D  N  L  D  H  L  Q  E  A  S  I  G  I  G  R  D  E  V  Y  L  N  A  R  D  G  V  R  R  A

103990  TCCACCATCACCTGCGAGTCGGGCGGCGAGAAGGCGGTCGGTTGTCGAACAGTCGGCGACCAGGTGGACCAGGTCGTTGACGTCGTGCGC
        <E  V  M  V  Q  S  D  P  P  S  F  A  T  A  N  D  G  L  E  A  V  L  H  V  L  D  N  V  A  H  A

104082  GGCGACCTCGATGTCACGGTCGATCACCCGGAACTCGAATCCGGGTGTAGTGCTGAAGCACGTCGATCAGTG
        < A  V  E  I  D  R  D  I  V  G  F  E  I  R  T  Y  H  E  V  E  S  Q  A  A  R  L  V  D  I  L  A

104174  CCGCCGGCTCGGCGTGCACGGCGGGTGGAGTCGGCACCAGCAGGTTCTCGTTGTCGGCCATCCGGGTGGCCAGGTGGTCG
        < A  P  E  R  Q  V  R  T  S  D  A  G  A  L  V  L  L  N  E  D  N  R  R  M  R  T  A  L  H  D

104266  AGCTGGAACAGCTCGGCCAGCCGGTCCGGGTCCTCCTGCGCGGAGGCGCGCAGCCGCTCCTCGTCCGGCTACGGCCTCCAGGTGGACGCGT
        <L  Q  F  L  E  A  L  R  D  P  D  E  E  G  R  E  L  R  D  L  H  F  I  L  R  D  V  L  I  Q  S

104358  ACGGCGGGCAGGTTGACGAACATGGTCGGCCAGAACTCGTCCTTGCTGCCGACCAGCTCGGCAGCCTGTTGGCCGCTGCCGGGGAGAGCTGG
        < R  R  A  L  N  V  F  M  T  A  V  S  A  R  L  A  A  Q  E  A  A  T  R  V  A  E  L  H  V  A  N

104450  TGAACGCCTCGGTCACCTGGCCGAACTCGTCCTTGCTGCCACCGCAGCTGCTGGTTGGCCGCTCGCTGCACCGGGAGAGTCCAGGTCGCAGCGA
        < F  A  E  T  V  Q  G  F  E  D  K  S  R  V  P  L  P  E  A  I  Q  N  A  A  Q  V  P  S  L  Q

104542  CTGGAAAACTGCGCGGATCGCGACCAGGCCTGGGGCAAACGTACTGGGACGATGCTGAGCGACCACCCTGGCGCAGGTCGCAGCGCGA
        <S  S  G  Q  P  D  R  L  R  A  V  A  Q  P  L  G  T  Q  A  I  S  L  A  G  Q  R  L  D  R  L  S

104634  GCGGGCCATCGACCGGGCACCAGGTACGCCGGGAACATGCCAGACATGGCCGTCGAGCTCTGGAGGAACAGGCCGGTCTGGAGGAACACCGTGCGCT
        < R  A  M  S  R  A  V  L  Y  A  F  L  I  A  L  L  M  G  L  L  L  G  T  Q  L  F  V  T  R  Q

104726  GTACGTCGGAGCGGAGCGCGTTGGCCTGCTCGGCGTGCTTGACCAGTTCGATCAGTTTGGCGCAGGTGTAGTTCTGCGCCTCGCG
        < V  D  S  R  L  A  D  A  Q  K  V  V  N  G  D  L  K  A  E  V  T  R  I  L  K  A  S  A  V  M

104818  GCCGCGTCCCACTGATCCGGCCGAACGGCTCGGCGTTGCCATGCTGCGTCGAGCTTGCCGTCGTTGCCGTGTAGCTGGCGACCATG
        <A  A  D  W  Q  D  P  G  F  P  A  N  A  M  S  G  N  T  N  G  D  L  W  G  T  Y  N  Q  A  E  R

104910  CCGGTCGCCGGCGCGACGGTCGTCGTGCAGGTCGACGTCCGACTCGTCGAGGTCGCACCGCCTTGAAGCTTTGCAGTGCCGACTGTCGCGG
        < R  D  G  G  A  V  T  Q  D  H  L  D  S  E  D  L  S  A  V  A  K  F  S  Q  L  A  Q  Q  Q  G  T
```

FIG.11A(91)

```
105002 TGCCGCTGGCGATGTAGTCGGTGCGCAGGATGGGGGTCAACTCGCGCTGGATCAGCCGGTGCACCAGACCCGGCGGGACCGAGAGGTAT
       < G S A I T D T R L I P T L E R Q I L A R H V V V R R V S L Y
105094 TCCTTCTCCGGGCGACGGCTGCCGCGGCCCATCCGGTCGCTCAGGTCGTTGTCACCGGCGAGGTGGGTGGCGAGTCGCGGATGGACAG
       <E K E R A V A A A R M R D S L D N D G A L H T A S D R I S L
105186 CAGGTCGTTGATCAGGCCCTCGTACGCCTGCATGGCGTCGATGATCTTCAACTTGCCGTTGAAGACCTGGCTGCGGGTGCCGGAGGTCCT
       < L D N I L G E T A Q M A D I I K L K G N F V Q S R T G P L D K
105278 TCAGGTTCTGGTCGATCCCGTCGAGGAGGCCCTGCAGGCTGCTCGGCAGGCCGTGCACTTGTCC
       < L N Q D I G D L L G E L S S P L G D V E G R Q Q L Y P V K D
105370 TGGTCGACCCGGATGTTGACCGGGTTGTACGCCTCCTGGTACTGCGCCTTGGCCTGGTCGCCTGGTCCCCGAGCAGCAACACCGGGAGGT
       < Q D V R I N V R N Y A E Q Y Q A K A Q D G S A G L L V A S T
105462 GCGTTCGTCCTGGAGGCTGTTGACCAGGTCGCCGAGTAGCCCACCAGATTGGCCACCAGGATCATGATGAGACCGAGCTTGGACCAGATCGGCATGTC
       < R E D Q L S N V L D G S Y G V L N A L D G S R N A N N L T E L
105554 GGTTGTCGACGAGGCCACTGTGCCGACGACGAGTCGGCGACCAGTCTTTGCTCACGTCGTTTGCTCACGTCTTCGGTCTTTGCTCACGTCACCGCCCTCGCGATCACAGC
       < N D V L G S T G V V V T A I T P V I M I L G L K S E I P M
105645 GCGGAGCCGGCCGGCGACCGGGCAGTCGGCGACGAGTCGGCGACAGGAACCCGCCGTCTTCGGTCGTTTGCTCACGTCTTCGGTCTTTGCTCACGTCACCGCCCTCGCGATCACAGC
105737 GTTCGCGCGTTGCCCCGGGCAACGTCAGGCGACCGGGTCGACCTCGGCGGCGCCACATCCTCAGCCGGTGGCCCCACATCGGCCGGTGAATTGCTCGCAATCACGCCGTCTTCCAAAGAGAAAAGCCCA
105829 GGCTGGCCGTCGCCGGAGGTGTGATGAGATGTTGATGAGATGTTCGCAATTTGCTCGCAATCCGTCCAGCCGGAGTGACTGACAGTAATGGATCACCCC
                                                          > M D H P
106011 CTACAAGGATGGTGATGACCCTACGTTACCGCGCCAAAACGGTCTTGTGACTCTTGTGACTCTTGTGGACTCACCCCAGTCGTGGGACGGCGGGCGGCCGTGG
       > H R L V L L A G P S G S G K S T I A Q Q T G L P V L C L D D F
106103 AAACGATTGCCCGGCTGCCGCGGGACGGCGAAGTCCGGTTTATGCGATCGGCGGTGCCGGGTGGCCACCCGGACATTCGAG
       > Y K D G D D P T L P R Q N G L V D W D S P Q S W D A G A A V
       >E T I A R L A R D G K A E V P V Y A I G A D R R V A T R T F E
```

FIG.11A(92)

```
106195  GTCGCCGGATCGCCACTTTTCGTCGCCGAGGATTTTCGCCGCCGAGATCGTCGAGGAATGCCGACGGCGAGGGCTGCTCGCCGGGGCGTA
        > V  A  G  S  P  L  F  V  A  E  G  I  F  A  A  E  I  V  E  E  C  R  R  R  G  L  L  A  G  A  Y
106287  CGGCTGCCGCCGGCCGACCACCTTTTCCGCCGAGACTTGCTCCGCCGCAGCCAGCGCAAGGCTCCCGGGATGCTGCTGCGGC
        > A  L  R  R  P  R  G  T  T  F  F  R  R  L  A  R  D  L  A  E  Q  R  K  A  P  G  M  L  L  R
106379  GCGGCCTGGCCTGCTGCGGCGGCCGAGCCGGTCCTGCGCCGCAGGCAGCTTCCGGAGCCCTCACCCGGCCCTGCTGATCACCTCGTCGATGAT
        > R  G  L  A  L  L  R  A  E  P  A  V  L  R  R  Q  A  G  L  G  A  H  P  A  P  A  R  E  V  L  P
106471  CGGGTGGCCGACCTGCTCGCCGGCCACCCCCACCACCCTGATCAGCCGGCTTCCGGTACGCGGGCTTGATCACCTCGTCGATGAT
        > R  V  A  D  L  L  A  G  H  P  H  H  H  P  •  •  G  L  L  K  G  Y  A  P  K  I  V  E  D  I  I
106561  GGCCAGCCGCTCGAACGGGATGAACGCGTTCATCGCGTTGAACATTGGAGCCGTCCTTCCAGCCGTAGCCGAAGGCCTCCG
        > A  L  R  E  D  F  P  I  F  A  S  K  M  A  N  I  T  F  W  Q  L  E  K  W  G  Y  G  F  A  E  A
106653  CCAGCAGGCCATCTCCGGACATCGAGGTGCGCTCATCAGCGAGGTGTTGTCGGTGTTCACCGTCGTTGTTGTTCACCGTGTTCACCGTAGCAGAAGC
        > L  L  A  M  E  R  S  M  S  T  G  S  M  L  R  N  D  T  N  V  T  V  R  F  R  L  D  R  L  L
                                                                          BamHI
                                                                          junction marker
106745  CCGATCGGGTGCTCGGCGGATCGACGCGCGGCGGTCTGCACGTTCGACGACGGCACAGCTCCAGCGGGATCCGCTTGTCCCGCACGTA
        > G  I  P  H  E  A  I  S  A  A  A  G  T  Q  V  N  S  S  P  C  L  E  L  P  I  R  K  D  R  V  Y
106837  CGCGGGCCAGCCGGACACGGGCCAGCACGGGCGGGTGCGCCACGATGCGCTCGTCGATGTCGTTCACGATGTCGTCACGATGCGCACCACT
        > A  A  L  R  G  L  V  P  P  D  G  P  T  I  D  D  V  I  R  V  G  H  G  L  R  D  A  G  C  W  Q
106929  GGATGGCCTGCCAGATCGACGGCAGCCTGCGCGAACGCTCGCCCGGCGTGAAGTTCTCCCGGCTGCAGGTACTCGAAGGCGTCC
        > I  A  Q  W  I  S  P  L  G  F  A  E  G  A  H  I  T  F  H  F  N  E  R  Q  L  Y  E  F  A  D
107021  AGGTGCCGGGTGGGCGGGAATCCCGGCCTCCGCCCCGGCGAGGCCGTGCCGCCACGCGCGGTGCGCGTCGCCACGCCGCAGTTCGGCGAT
        > L  H  R  T  P  P  F  G  A  E  A  G  A  I  D  F  G  V  V  G  A  D  R  H  R  V  A  L  E  A  I
107113  CTCCTGCCGACCGGCTGCGCCGTCGAGCATGGCGCGATGGGCGTCGGCGGGCGTCGGCGAGCCGCGCCCTCGG
        > E  Q  S  R  A  A  H  R  M  A  T  L  L  T  G  V  R  I  P  H  G  A  D  A  A  L  A  A  G  E  A
```

FIG.11A(93)

```
107205  CGAACCCGGGCGACGACCGCCTCGACCACCTCGTCCAGGTCCCGCTCCAGGTGTGCTCGGGGGGGAACCGCACCTCGGCGTAGACG
        < F G A V V A E V V E D L T L D R E L H Q E P A F R V E A Y V
107297  ACCCGTCGGCGGCCAGGTCCAGCGCGCACTCCTGGGCAGCCGCGCAGTGCGGGGCGGTCTGCATGACCGCCACGTGTGGGCGAACGT
        > V G D A A L D L A C E Q A V R R L A P A T Q M V A V T H A F T
107389  CTCCAGGTAGCGCTCCAGCGAGCCGGAGTTCGCCGCCGCGACGAGCCGCTTCCGGGTCGGTGGTGGGCAGTCGTGGCCGA
        < E L Y R E L S G S N A A A V F W R G L A E P D T T P L E H G V
107481  CCTCGGCGGCCAGCTCGACGATCGTCGCCGGCCGACAGGCCGCGTCGAGGTCGTGCAGCAGCGCCTTGGGGACCTTGACGATGTCCTCG
        < E A A L E V I T A P R L G G D L H D H L L A K P V K V I D E
107573  TATGAGATTGCGACCATGCCCAGACCCTAGTAGCGACCGGACCCGGGTCGCCGACGCTGGGAGGATGTCCAGGTGATGACCCC
                                                                > M D P
                                    < Y S I A V M
107662  CGCATCGTCGACCGGCTGCGTTGCCCGGTCTGCGCGGAAACCTCACCGAGGCCGCCGGGCGCTGCCGCGCG
        > R I V D R L R C P V C A E P L T E A A G T T R A L R C P R R
107754  GCACAGCTTCGACGTTGCCCGCCAGGGGGTACGTCGACCTGCTCGCCCGGCCGCACGTGGGCGACACCGCCGAGATGGTGGCCGCC
        > H S F D V A R Q G Y V D L L A G R A P H V G D T A E M V A A
107846  GCGCCGACTTCCTCGCCGCCGGCCACTACGACACCCTCTCCGCCGCCGCTGAGCCACCCGCCGGAGGCC
        > R A D F L A A G H Y D T L S A A L A A A A L S H P P E A
107938  CCCGGAGGCGGACGGCTGGCCGTCGGCAAAGACGGGCAGGATGCCCAAGCCGGGATGCGTCGCTGGACATGACGCGTCCGCCGGACAGCC
        > P G A D A S A G K D G Q D A Q A G R D A S A G H D A S A G Q P
108030  GGCCGTCGGGACGTACCCGCTGGTGGTGGACGCGGGCGCCGGGCAGCGCGGGGCGCTGCCGGGTGCTGCCGACGCCGTGG
        > A V G T Y P L V V D A G A G T G R H L A A V L A A L P D A V
108122  GCCTGGCCCTGGACGTCTCCAAGCCGGCGCTGCGCGCGCGAGCGCGCCACCGCCCACCACTGGACACCTGGCGGCGG
        > G L A L D V S K P A L R R A A R A H P R A A A L A D T W R R
108214  CTTCCGCTGGCCGACGCCAGCGTCGCCGTCCTGCTCGACGTCTTCGCCCCGCGCAACGGCGCGGAGTTCCGCCGGGTGCTCCACCCGGCCGG
        > L P L A D A S V A V L L D V F A P R N G A E F R R V L H P A G
```

FIG.11A(94)

```
108306  CGCGCTGCTCGTGGTCACCCCCGCCGAGGA CACCTCGCCGAGCTGGTCGACTCGCTCGAAGGTCGACCCCGACAAGGCGGACC
         > A  L  L  V  V  T  P  A  E  D  H  L  A  E  L  V  D  S  L  D  L  L  K  V  D  P  P  D  K  A  D

108398  GGGTCGCCGGGAGCCTGCGCCGGCCACTTCGAGCAGACCGCCGAGAGCGTGTGCGGGCCCGGAACTCACGGCCGGCAGGTGGCCACC
         >R  V  A  G  S  L  A  G  H  F  E  Q  T  A  E  S  V  L  R  A  R  L  E  L  T  G  R  Q  V  A  T

108490  CTGGTCGGGATGGGACCCAGCGCCTGGCACACCGACCCGGCCACCCTCGCCGCCCGGATCGCGGCTACCCGAGCCGGTCCGGGTGACCCT
         > L  V  G  M  G  P  S  A  W  H  T  D  P  A  T  L  A  A  R  I  A  A  L  P  E  P  V  R  V  T  L

108582  CGCGGGTACGGCTCGGGCGTGTACCGCCCCCGCTGACCGGGCGCGGCCCCGCCGCTCAGGTGGAAAGGTCGACCTCTTCCAGCCGGCGGCTC
         > A  V  R  L  G  V  Y  R  P  R  •           <  •  T  S  L  D  V  E  E  W  G  P  P  E

108674  CTCGTGGTAGGGCCCTGCAGGACCACCGCCACTCCAGCGCCCCACCGGGCTGCCCGATCGCGTTGGCGTCGACCAGGCCGGCGGCGACC
         < E  H  Y  P  G  R  L  V  V  A  W  E  L  A  W  R  R  Q  G  I  A  N  A  D  V  L  G  P  P  S  R

108766  GCCCGTCGCGCTCCAGTCGAGGTACGGCCGGCTCCAGGTCGAGGCAGTAGTGCAGGTGCAGGGCCCCGCCCGGCCGGTGCTGGGGCGGGCC
         < G  D  R  E  L  E  L  Y  A  W  D  L  C  Y  H  L  D  L  L  A  A  A  D  A  P  H  Q  P  A  A

108858  AGGATGCGGGAGCGCCACTGCTGAAGCTCTCCCGCCGATGTGCGGGCCAGGGCCGCTCCACCAGCCGTCGACCGCTCGTCGACGTCGGGTC
         < L  I  R  S  R  W  Q  Q  F  S  E  G  G  A  I  H  P  L  R  E  V  L  R  E  D  V  P  L  T  P  D

108950  GAGCTGCTTGGCCAGGCCGAGCCACCCAGCGCGAGAACAGCGCCGTGGTGCAGCAACGACCGGTTCGCCCGGCCGGTGTCGCCCCATCA
         < L  Q  K  A  L  G  L  V  W  A  L  S  F  L  A  D  H  H  L  V  F  S  R  H  D  G  R  G  G  M  V

109042  CGAACTGCCACTCCGGCCTGGTGACCAGGTCGACCAGGTTGAGCAGCTCATCGCGCCTTGCCGCCGGCATGCCGAAACACCGG
         < F  Q  W  E  P  P  T  V  L  D  V  L  H  S  N  L  L  W  S  M  A  A  Q  A  P  M  G  F  C  R

109134  GCCAGGATCACGTGCAGCACGGTCGATGCGCCTCGATCTCGACGGTCGGCCGCCAGTCGTCGGCCTCCCACAGGGGAA
         <A  L  I  V  H  L  V  A  I  R  A  E  I  E  V  T  P  R  L  E  I  E  D  G  P  E  W  V

109225  ACTGGGCTCGGTGGCAGCGGGACGCGGACCCCAGTCGTCGCTGGCCGTCAGGACACCTCTCGCGGACCTTCGGGAGCGGAAACGCGCACG

109317  GCTCAGATCCCTGTCAGTGCATCGGCTCCAGTGCCGGTGTCCCCCTTGGCCTGGGAGGATAGCGGTTCACGACGAGCGGCACCACGGGCGGG

109409  CGGGGGGGGGGGCCAGCGCCGGGTTCAGCGATCAGCCGATCCGCTCAGCCGATGACCAGCGCCTGCGGGGCGGTCGGGCGGGATCCGTACCGCCGGACCGCCTCG
         BamHI
109501  GCCAGCGCCGCCGGGATCC
```

```
5740 ACG GGC GCG CAG CCG GTG GGC GGC GGC CTC CGC GTA GTG CGG CTT GTC GAA CGC CTC GGC TTG CGC CAG CTC GCG GGC CCG
     < R   A   R   L   R   H   A   A   A   A   E   A   Y   H   P   K   D   F   A   E   L   A   R   Q   L   A   R

5830 CGT GTC GAG CCC GGC GCC GCC GGT CAG CAG GTT GGC CCG AGC GAG GTC GAC GTC GAC CTC GCA GCA GAG GAC GTC GAG CCC GGC GCA CAG CCC GGC GCA GGC GAG CAG CCC GGC GCA
     < T   D   L   G   A   G   L   L   G   N   A   R   A   L   D   L   A   A   E   D   V   D   S   A   L   L   G   A

5920 AAG GCT CGG GTG CAG CAG CAC CGC GGT TTG CAG GAC CGC CTC GGA GCA GCC GTA GGC GGT CAG GAC CGG GCC GCA GAC GCG GAA CGC CGA GCG CAA GCG GCC ACT
     < L   S   P   R   H   L   L   A   L   V   T   L   L   Y   G   S   G   C   C   P   D   W   V   T   A   P   S   T   P

6010 GCG CAA CTC CAG CGC GGT TTG CAG GAC CGC CTC GGA GCA GCC GTA GGC GGT CAG GAC CGG GCC GCA GAC GCG GAA CGC CGA GCG CAA GCG GCC ACT
     < R   L   E   L   A   T   Q   L   V   E   S   A   L   R   V   P   F   A   P   F   G   P   A   S   R   L   V   A   G   S

6100 GCG CAG CCG GTC GCC GTA AGC GCG ACC GCG GTA AGT CAC ATG CCC TCC CCG GCG CAC CCT ACC AAT CCG GCA CCG CCG GGC
     < R   L   E   L   A   T   Q   L   V   E   S   A   L   R   V   P   F   A   P   F   G   P   A   S   R   L   V   A   G   S

6190 CGG G TCA GGC AGG CCG GGA CTC GAT CCA GTG GAA GTC GGT GGG AGG CAG CCC CGC GAC GTC CTC CAG GGA CAG CCC CTT GCC GCA CAG
     <.  A   P   R   S   E   I   W   H   F   D   T   P   P   L   P   T   V   D   E   L   S   L   G   A   K   G   C   L

6281 CCG GTC CAG TTC GTC GCC TCG GGT CCG CTC CAG GCC CAC CTG CCC GTT GAC CAT CCC CAG GTA CGC GTC GGT GGC CGT CCG
     < R   E   L   D   G   R   T   R   E   L   G   Q   G   N   V   L   M   G   V   D   T   L   Y   A   L   A   N   A   A   P

6371 GCC GAC CAC GTC CGG CAG CAC GTG CCA ACC GTG GAT CAT GAT ATG GTC TTT GAG CAG GTA GAG GAC CCT CTC GAA GAA GTC ACC CAC CTC GAT
     < G   V   V   D   P   L   V   H   D   I   M   V   I   R   G   G   P   A   V   A   E   A   C   H   R   L   I   G   T   A

6461 CCG GCC GCC GTC GCC GTG ACC GCC GGC GAT CAC GTG GCG GCG CAG CGG CTC CCC GCC GTC GAG GAC GCT GCT GTG CCG CAC CCG CAC GCC
     < R   G   G   D   G   W   G   H   I   V   S   K   L   L   Y   L   D   A   D   A   P   V   R   E   F   F   D   G   V   E   I

6551 CCG GCA CCG GTC GGC GAG GAC GTC CCC GCG GCG CAG CGG CTC CCC GCC GTC GAG GAC GCT GCT GTG CCG CAC CCG CAC GCC
     < R   C   R   D   G   V   G   A   R   R   L   N   G   A   A   E   A   S   G   S   A   S   D   Y   L   V   G   R   V   G

6641 GGG GTT CGC GGC GAG CAC GGC CAG CAG GGT GCC TCC GCC GTC GAC CAC CGT CCG GGC CAG GTC GGT ACG CTC
     < P   N   A   A   L   V   A   A   L   L   T   G   D   G   G   G   V   D   V   T   R   V   G   A   L   D   T   R   E

6731 GGC AAC GGC CGC GAC GTC GCT GTG CAT CGC GGG TCG CCC CAC GTA GCT GAA
     < A   V   A   A   A   V   S   H   T   V   Q   S   M   A   A   N   Y   L   E   S   L   D   P   R   G   G   V   Y   S   F
```

```
11289 TTC CGC GCC ATC GCC GCC CTG GTG GCC GAG CGG ACC GGT CGG CCA CCG GTG CTG GCC GTG CCC CCG GAC GAG GCC CGG GTC
      >F  R   A   I   A   A   L   V   A   E   R   T   G   R   P   P   V   L   A   V   P   P   D   E   A   R   V
11379 AGC GAC TTC CAC GAC ATG GTC GTT GAC GCC TCG GCC TTC CAG GCG GTC ACC GGG TGG GCG CCC CGG GTG CCG TTG CGC CTC GCG CTG GAC
      >S  D   F   H   D   M   V   V   D   A   S   A   F   Q   A   V   T   G   W   A   P   R   V   P   L   R   L   A   L   D
11469 CGC ACC GTC GCC GCG CTC GCC GAC AGC GAC GAC GAG GGC CCC GGC GGG ACG CGG GCG GAT CAG GCC CGG
      >R  T   V   A   A   L   A   R   D   D   S   G   P   E   A   P   G   G   T   R   A   D   Q   A   R
11553 AAG CCG GAC TCG ATC TCC AGG CAG GTC CGG TAG TCGGGCAGCAACCACGGCGAGCCCTGGTCGAAGGTGCGGTCCCGCTCCGACAGGATCGGTTCGAC
      >K  P   D   S   I   S   R   Q   V   R   .
11663 GTCCTCGGGGATGGGCAGGCCCAGGCCCGGGTCGAGCGCGGTCGAGGACAGTTCGTTCTCGAAGACGTACTCCTGGACAGGAGCGGTGTCGTCGGCCAGGGCGACGAAC
11784 ATGTGCGCGACCCGACCCGGCAGGCACCGCGGGACGTAGTCCTCGCTGTCGAGCACCAGCTCCACTTGCCGAACCCACGGTCGAGCCAGGTCGAGCACCC
11905 GGCCGTGCGGGCAGGAGAGAACTTCGCGGTGCCGGTGAAGTGACCCACGCAGGGTCCCCGGCGCAGCGCCTGTAGTGGTCTGCCGCACGGGAACAGCGGGTA
12026 CCCGACCGGTGTCCGGAACAACGAGTCGAGATACGGAGAGGAACACCCCCGGTAGACGGTGGGCGCGAAGGCGTCAGCGGCCGCCTTCGACGGTCAGCGGCGCGGCGGACACC
12147 GGCGGG
```

FIG.12K

EVERNINOMICIN BIOSYNTHETIC GENES

This application claims priority under 35 U.S.C. 119(e) to U.S. Provisional patent application Ser. No. 60/175,751 filed on Jan. 12, 2000.

FIELD OF THE INVENTION

This invention is directed to nucleic acid molecules which encode proteins that direct the synthesis of the orthosomycin everninomicin. The present invention also is directed to use of DNA to produce compounds exhibiting antibiotic activity based on the everninomicin structure.

BACKGROUND OF THE INVENTION

Everninomicin Biosynthesis

Everninomicin is an oligosaccharide antibiotic belonging to the orthosomycin group of antibiotics produced by *Micromonospora carbonacea* var. *africana* (ATCC 39149, SCC 1413) and is useful as a human medicine. Everninomicin chemically consists of several glycosyl residues attached to modified orsellinic acid. Everninomicin's antibiotic activity is believed to be due to its inhibition of protein synthesis by a mechanism that involves binding of the antibiotic to a ribosome (McNicholas et al., Abstract C-846, ICAAC, San Francisco, Calif., 1999). Everninomicin is structurally similar to the antibiotic avilamycin produced by *Streptomyces viridochromogenes* Tu57.

The biosynthesis and enzymatic steps necessary for synthesis of homologs of the chemical moieties contained in the everninomicin structure have been studied in other systems. These include synthesis of orsellinic acid (Type I polyketide), glycosyl group synthesis (deoxysugars), and glycosyltransferase responsible for covalent attachment of glycosyl groups. Orsellinic acid biosynthesis in *Penicillium patulum* and *Streptomyces viridochromogenes* Tu57 has been investigated (Beck et al., European Journal of Biochemistry, 1990, 192:487–498; and Gaisser et al., Journal of Bacteriology, 1997, 179:6271–6278). Glycosyl biosynthesis has been reviewed (Hung-wen et al., Annual Review of Microbiology, 1994, 48:223–56; Williams et al., "The Carbohydrates: Chemistry and Biology" Vol. 1B, 1980, 761–798; and Johnson et al., Current Opinion Chem. Biol., 1998, 5:642–9), and been studied in the erythromycin biosynthetic cluster (Summers et al., Microbiology, 1997, 143:3251–3262). Glycosyltransferases have been studied in a number of systems (Olano et al., Molecular Gen. Genetics, 1998, 3:299–308; Fernandez et al., Journal of Bacteriology, 1998, 18:4929–4937; and Wilson et al., Gene, 1998, 214:95–100).

Polyketides are synthesized via a common mechanistic scheme thought to be related to fatty acid synthesis. The cyclic lactone framework is prepared by a series of condensations involving small carboxylic acid residues (acyl groups). Modifications of the structure, such as ketoreduction, dehydration and enolylreduction, also occur during the processing. The synthesis is driven by a set of large multi-functional polypeptides, referred to as polyketide syntheses.

PCT Publication No. WO 93/13663 describes the organization of the gene encoding the polyketide synthase of *Saccharapolyspora erythraea*. The gene is organized in modules, with each module effecting one condensation step. The precise sequence of chain growth and the processing of the growing chain is determined by the genetic information in each module. This PCT publication describes an approach for synthesizing novel polyketide structures by manipulating in several ways the DNA governing the biosynthesis of the cyclic lactone framework. In order to adapt this methodology to other polyketides, however, the DNA molecules directing the biosynthetic processing must first be isolated.

Combinatorial biosynthesis with bacterial deoxy-sugar biosynthetic genes has been demonstrated (Madduri et al., 1998, Nature Biotechnology, 16:69–74) with the antitumor drug epirubicin (4'-epidoxorubicin) produced by *Streptomyces peucetius*. The heterologous sugar biosynthetic genes avrE from *Streptomyces avermitilis* and eryBIV from *Saccharopolyspora* were introduced into an *S. peucetius* dnm V mutant blocked in the biosynthesis of dausosamine, the deoxysugar component of epirubicin. Product yields were enhanced with avrE complementation demonstrating heterologous expression of sugar biosynthetic genes in combinatorial biosynthesis. Glucosylation of the glycopeptide antibiotic vancomycin (Solenberg et al., Chem Biol, 1997, 4:195–202) demonstrated that the heterologous glycosyltransferases gtfB and gtfE from *Amycolatopsis orientalis* expressed in *E. coli* produced glycosyltransferase capable of adding glucose or xylose to the vancomycin heptapeptide. Additionally, expression of gtfE from *Amycolatopsis orientalis* in *Streptomyces toyocaensis* resulted in glucosylation of A47934, producing a novel antibiotic. Thus, cloned glycosyltransferases can be used to produce novel hybrid antibiotics by glycosylation. In order to adapt this methodology to other glycosyl synthetic genes or glycosyltransferases, however, the DNA molecules directing the biosynthetic processing must first be isolated.

Orsellinic acid is synthesized by AviM, a Type I polyketide synthetase in *Streptomyces viridochromogenes* Tu57. An acetyl-CoA is used as the "starter" unit and three manonyl-CoAs are used as "extender" units for the synthesis of orsellinic acid. AviM has been shown to synthesize orsellinic acid by introduction of aviM into *S. lividans* TK24 (Gaisser et al., Journal of Bacteriology, 1997, 179:6271–6278). AviM has homology to the *Penicillium patulum* Type I polyketide synthase for 6-methylsalicylic acid (MSAS). The *M. carbonacea* EvrJ protein has homology to both AviM and MSAS and contains polyketide synthetic active site motifs resembling acyl carrier proteins, β-ketoacyl:ACP synthetases, and acetyl-CoA/Malonyl-CoA:ACP acetyltransferases. Thus EvrJ contains motifs necessary for the condensation of malonyl extender units with the starter acetyl-CoA unit.

The *M. carbonacea* EviI protein has homology to DpsC from from *S. peucetius* ATCC 29050. Purified DpsC has been shown to use propionyl-CoA as substrate and to be acylated by propionyl-CoA at the Ser-118 residue (Bao et al., J. Bacteriol, 199, 181:4690–5). This has led to the proposal that DpsC is responsible for the choice of proponyl-CoA as the starter acyl unit in the biosynthesis of daunorhubicin by acting as an β-ketoacyl:acyl carrier protein (ACP) synthetase three (KSIII), and catalyzes the first condensation of the propionate-starter unit with malonyl-ACP. Thus EvrI may be responsible for specifying the choice of acetyl-CoA as the starter acyl group in orsellinic acid biosynthesis and condensation with the first malonyl extender unit. EvrI contains a possible Cys-127 acylation site to form the EvrI-Cys-S-acetyl moiety. This active Cys is similar to the active Cys found in the *Streptomyces glaucescens* FabH (KSIII) enzyme.

The success in cloning and manipulating biosynthetic pathways for the products mentioned above demonstrates a need in the art to isolate and harness the biosynthetic pathway for everninomicin. Moreover, there is a need to employ everninomicin biosynthesis in the development of novel molecules by combinatorial biosynthesis.

Genetic Manipulation of Actinomycetes

The ability to insert genes into the actinomycete chromosome is important to avoid plasmid inhibition of secondary metbolite production and to allow the construction of recombinants that do not require antibiotic selection to maintain cloned genes. Vectors have been developed for use in actinomycetes that contain att/int functions for site-specific integration of plasmid DNA. The two systems available make use of the att/int functions of bacteriophage phiC31 (U.S. Pat. No. 5,190,870) and plasmid pSAM2 (U.S. Pat. No. 5,741,675). However, there is a need for additional vectors with att/int functions for site-specific integration in *M. carbonacea*.

The present invention addresses these and other needs in the art.

SUMMARY OF THE INVENTION

The present invention advantageously provides the DNA sequence for the gene cluster responsible for encoding everninomicin biosynthetic genes, which provide the machinery for producing everninomicin. As a result, the present invention provides the information needed to synthesize novel everninomicin-related compounds based on everninomicin, arising from modifications of this DNA sequence designed to change glycosyl and modified orsellinic acid groups contained in everninomicin.

Thus, in one embodiment, the invention provides a nucleic acid comprising an everninomicin biosynthetic pathway gene product from a *Micromonospora carbonacea*, e.g., encoding a protein as set forth in Tables 1a and 1b, and in a specific aspect having a coding region (CDR) as set forth in Tables 1a and 1b.

The invention further provides expression vectors, host cells, and related methods of expression of protein gene products, comprising the isolated nucleic acids of the invention.

In addition, isolated polypeptides corresponding to an everninomicin biosynthetic pathway gene product are provided. Specific open reading frames and amino acid sequences of the polypeptides are set forth in FIG. 11 (SEQ ID NOS: 2–175) and FIG. 12 (SEQ ID NOS: 183–204).

Furthermore, the invention provides modified *M. carboacea*, in which an everninomicin biosynthetic pathway gene is knocked-out, or, alternatively, over-expressed (or both). Similarly, the invention provides for metabolic engineering of new everninomicin analogs.

A particular advantage of this invention is the discovery of various everninomicin resistance genes, which can be used as selection markers. Thus, the invention provides a vector comprising an *M. carbonacea* everninomicin biosynthetic pathway resistance gene, and related methods of selection of transfected or transformed host cells.

In a related but distinct aspect, the inventors have discovered a *Micromonospora* site-specific integrase. The gene for the integrase can be incorporated in a vector for integration into any actinomycete, and, particularly *Monospora*. Thus, the invention further provides a method for introducing a heterologous gene into an actinomycete chromosome using this particular vector.

These and other aspects of the invention are better understood by reference to the following Detailed Description and Examples.

DESCRIPTION OF THE DRAWINGS

FIGS. 7A–B. (A) Map of pSPRH840 integrating vector. (B) Sequence of integrase gene (SEQ ID NO: 176) and deduce amino acid (SEQ ID NO: 177).

FIGS. 9A–B. Analysis of *M. carbonacea* and *M. halophytica* pSPRH840 insertion site att-B/attP region. (A) Alignment of pMLP1 attP region with religation clone edge sequences. (B) pMLP1 attP.

Figure 11A:
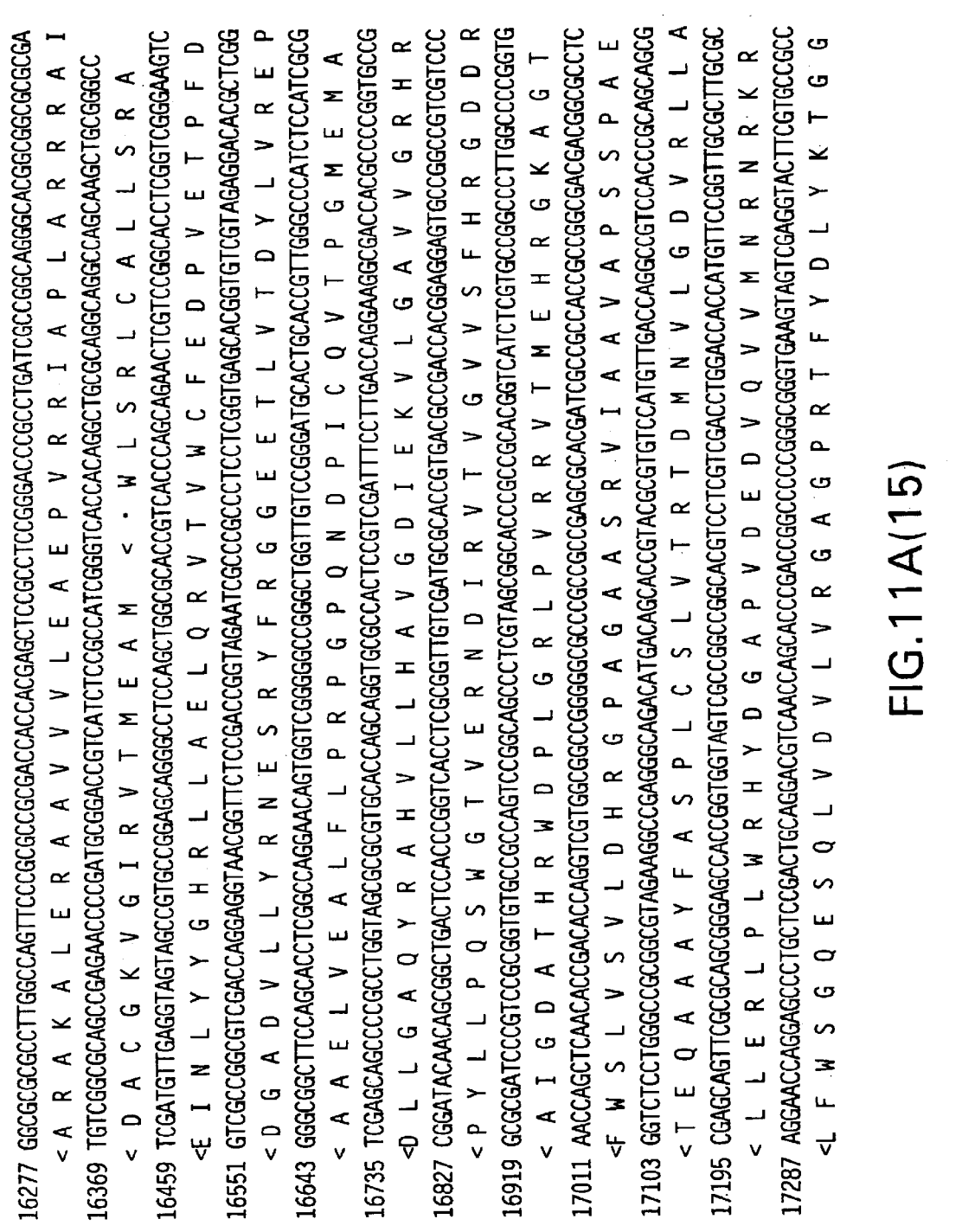
Figure 11A:
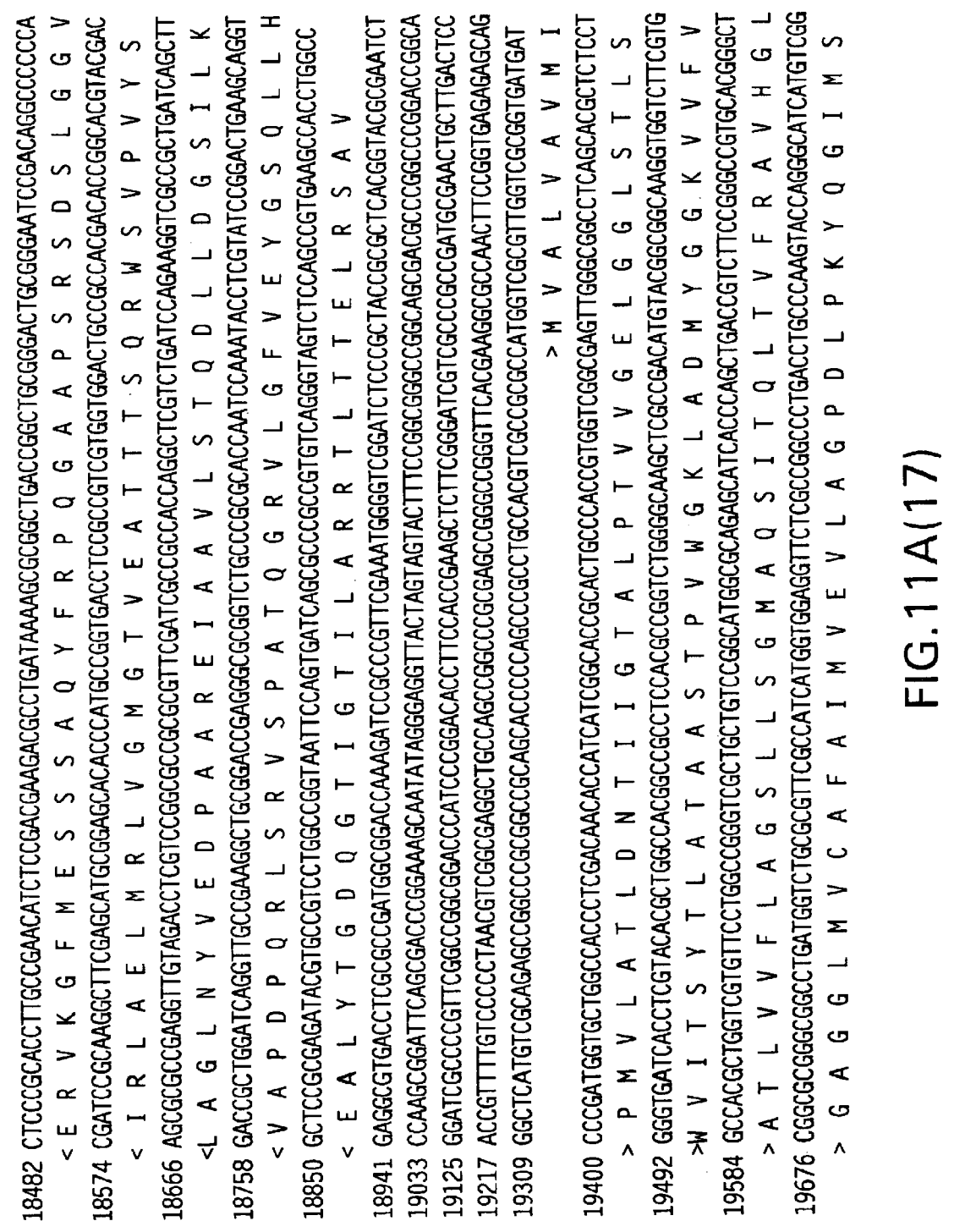
Figure 11A:
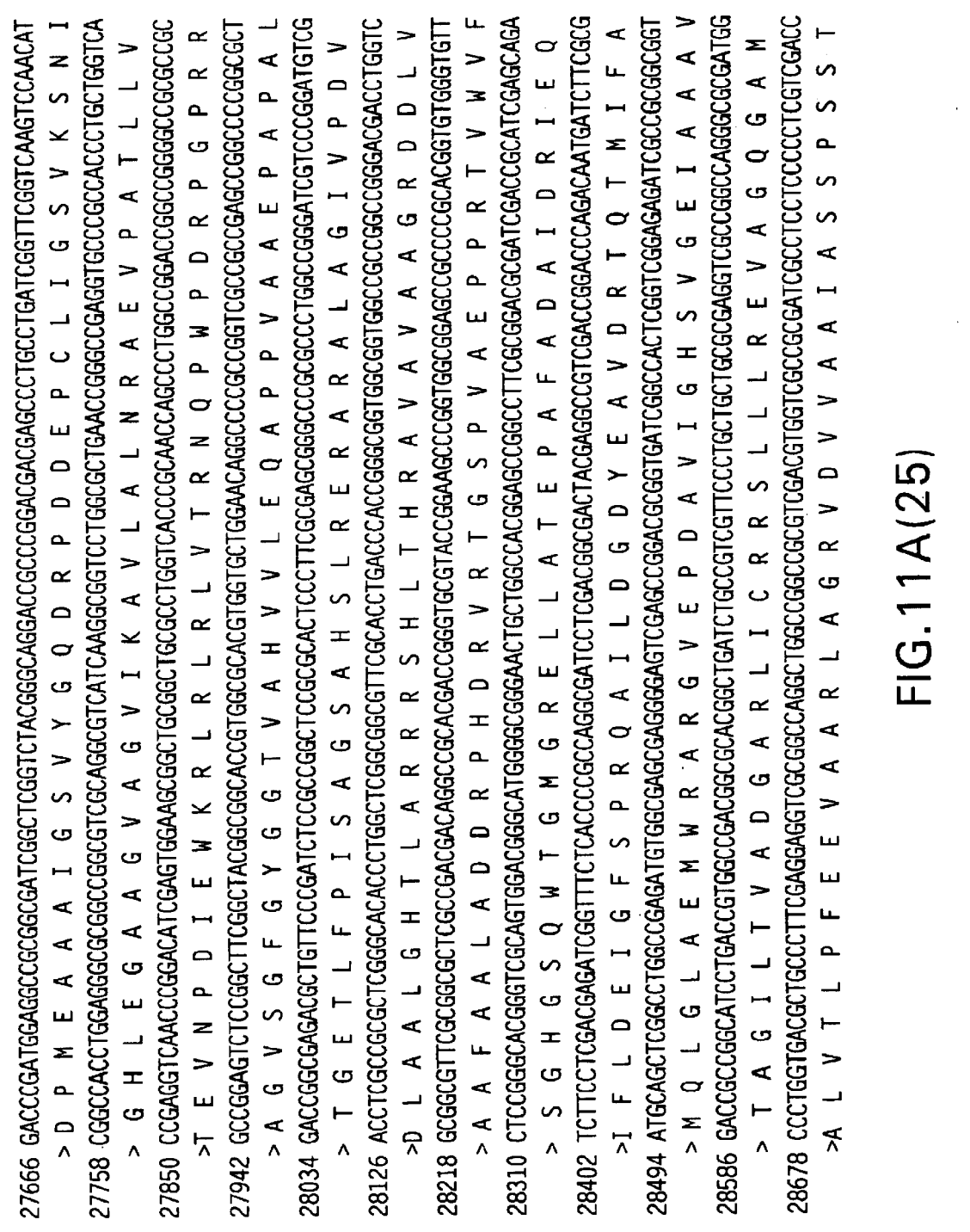
Figure 11A:
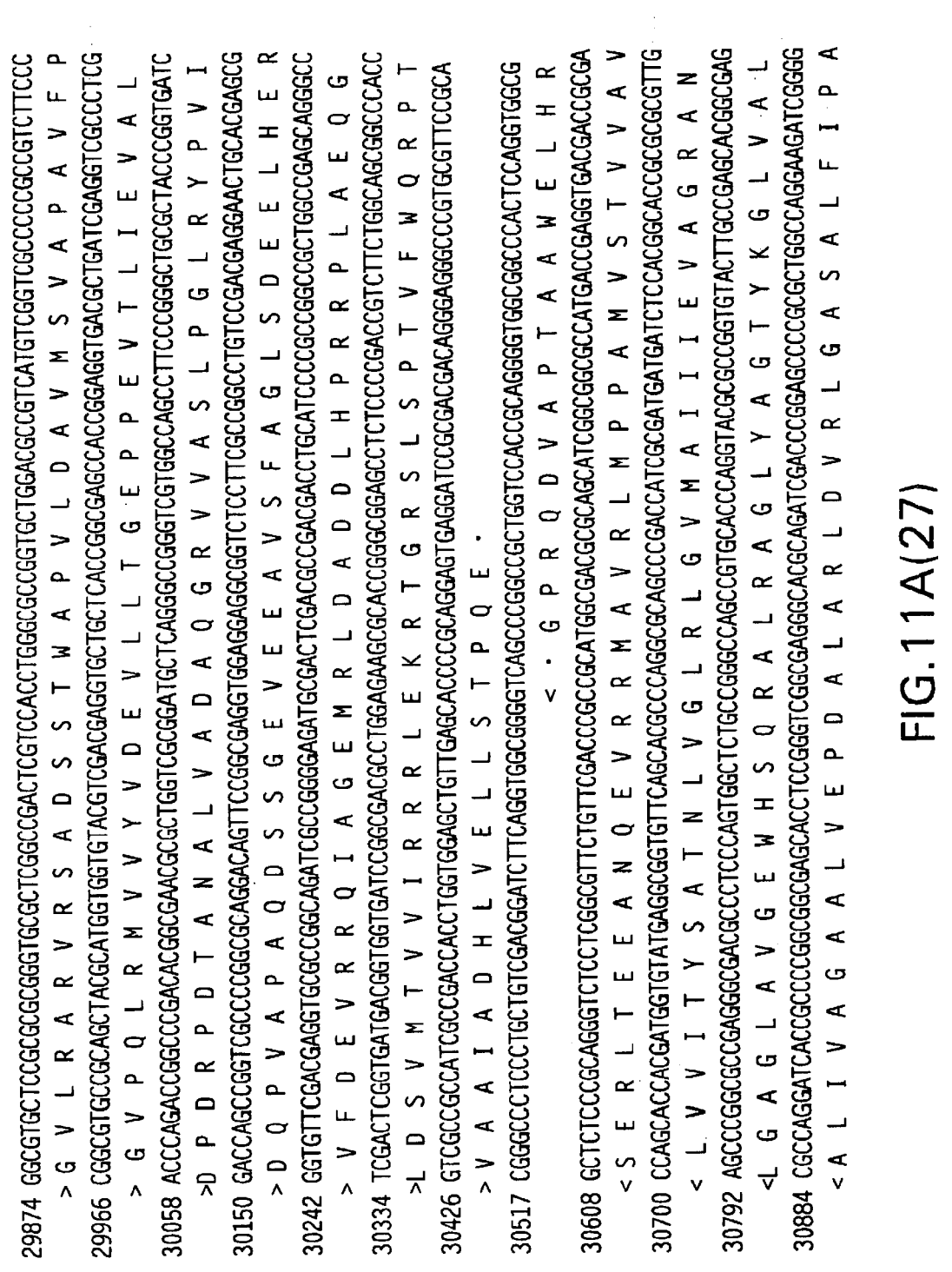
Figure 11A:
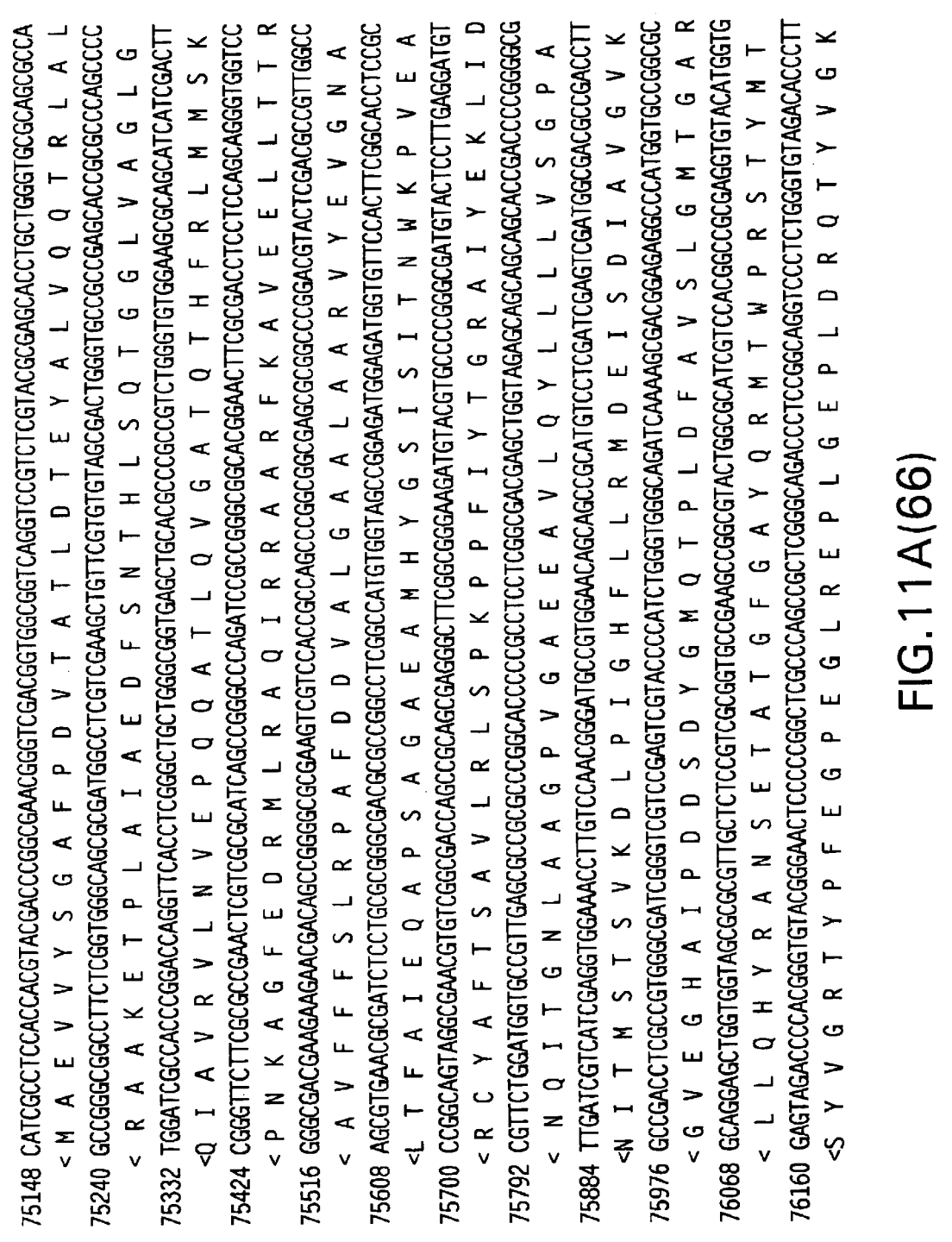
Figure 11A:
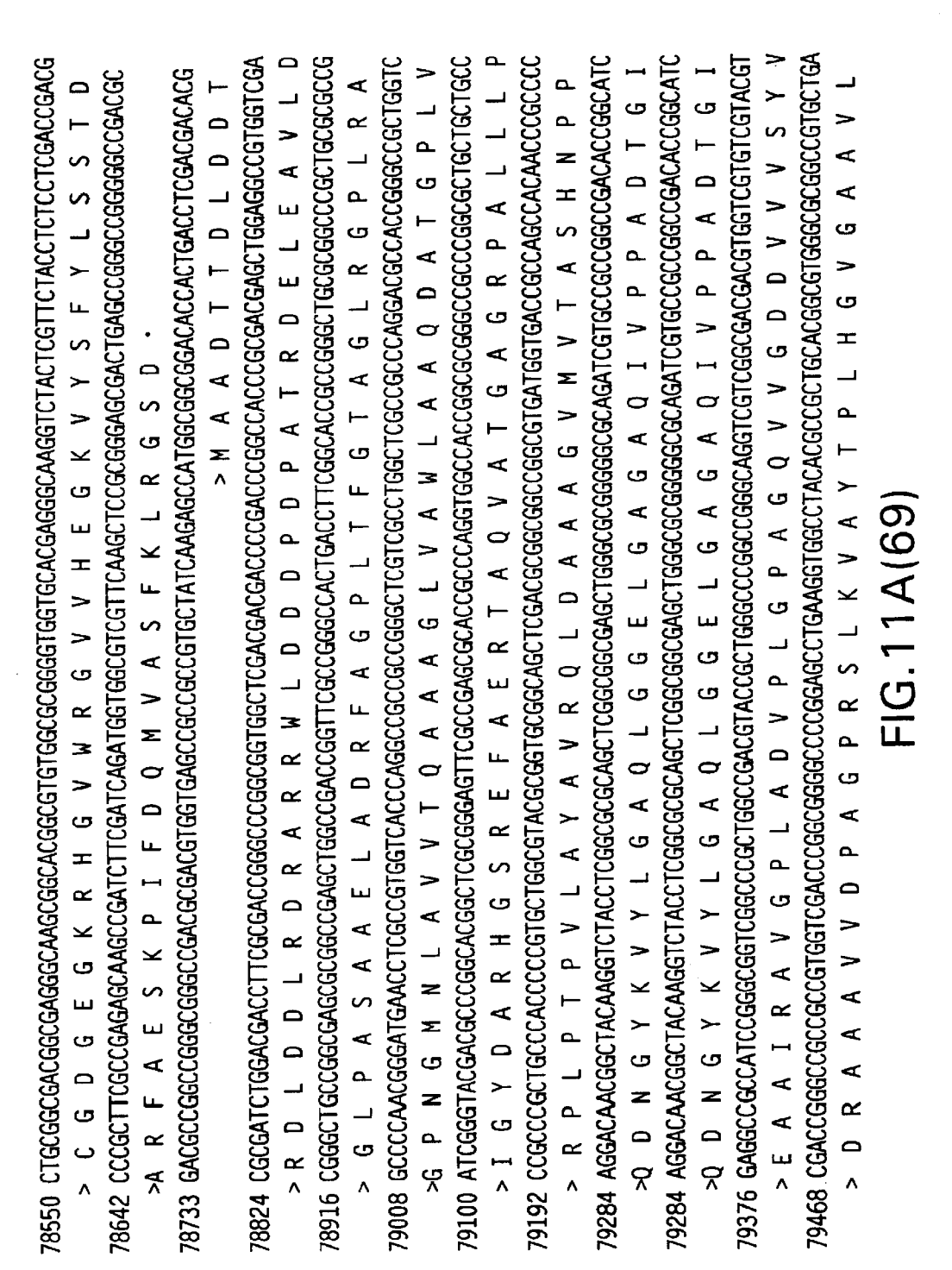
Figure 11A:
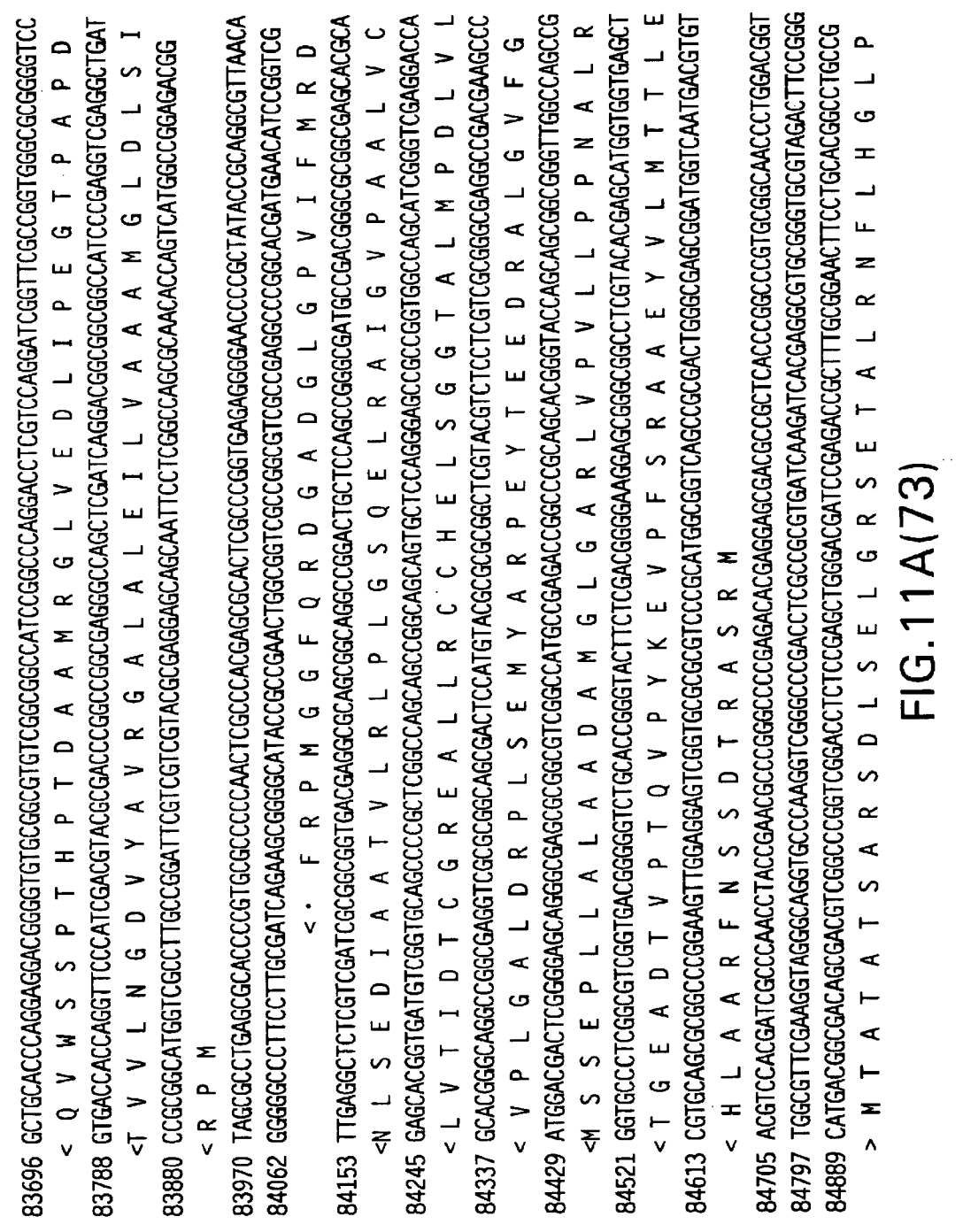

FIGS. 11A–11AD. Eveminomicin biosynthetic pathway locus sequence (SEQ ID NO: 1) with open reading frames and deduced amino acid sequences (SEQ ID NOS: 2–175).

Figure 12A:
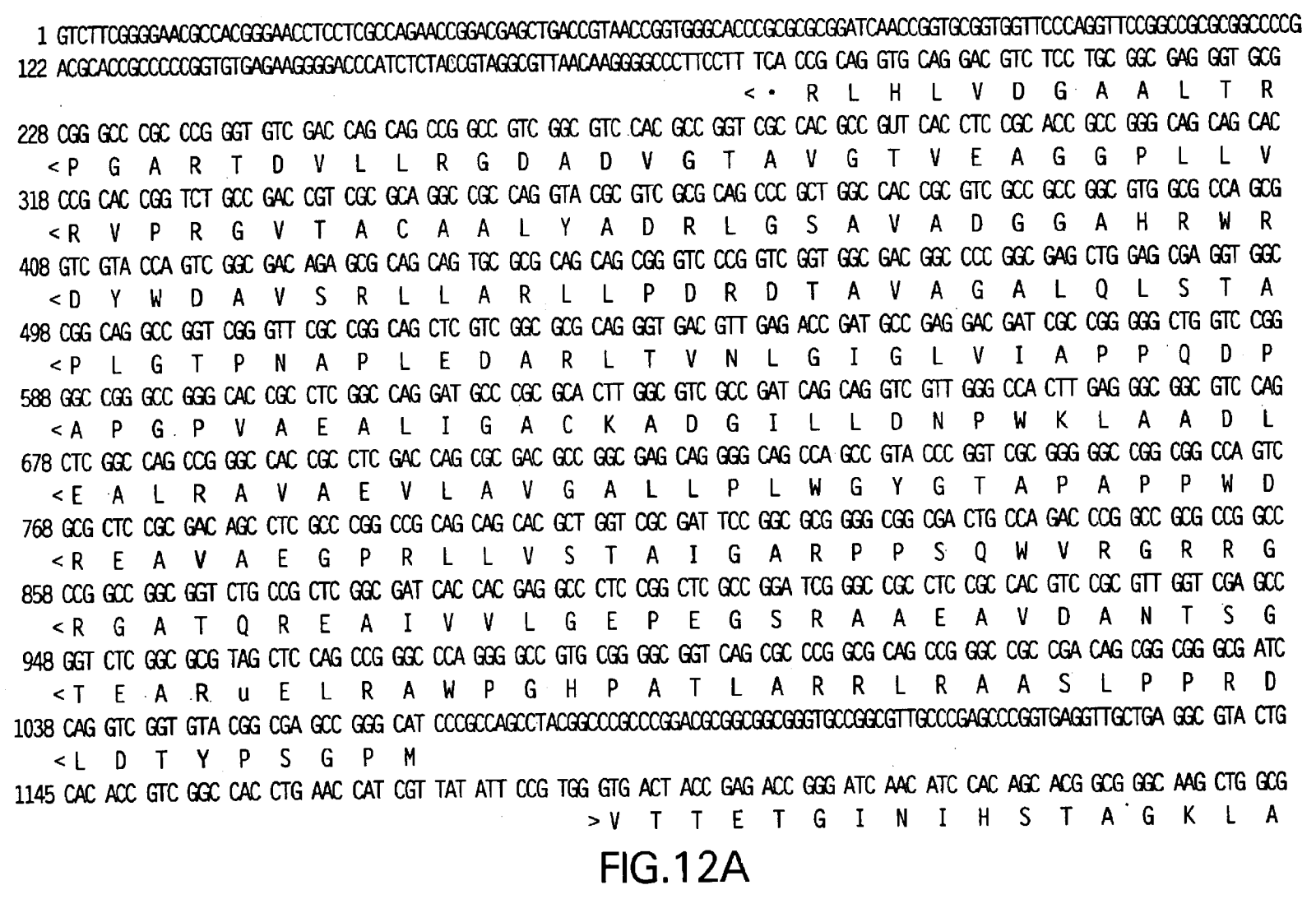
Figure 12B:
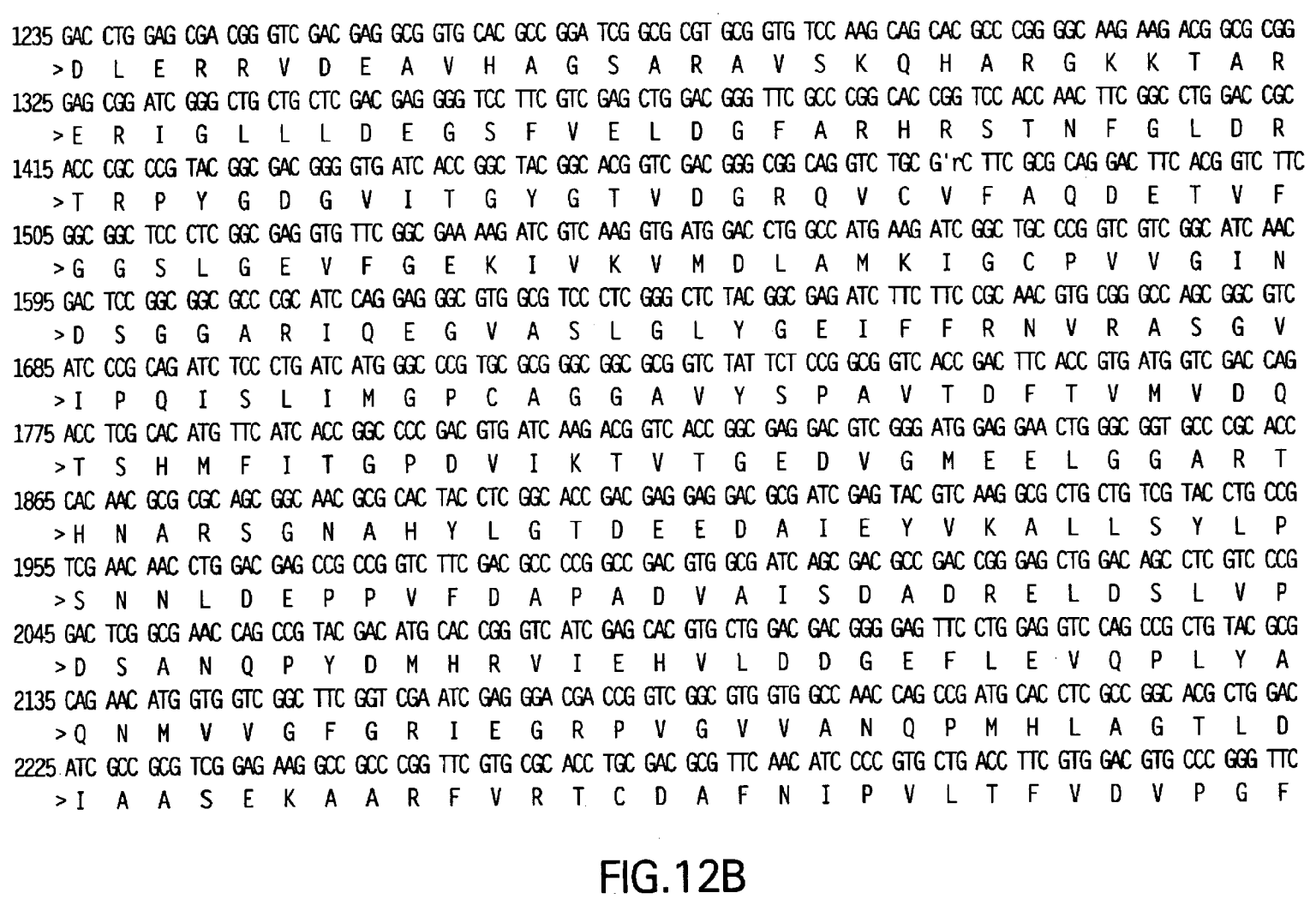
Figure 12C:
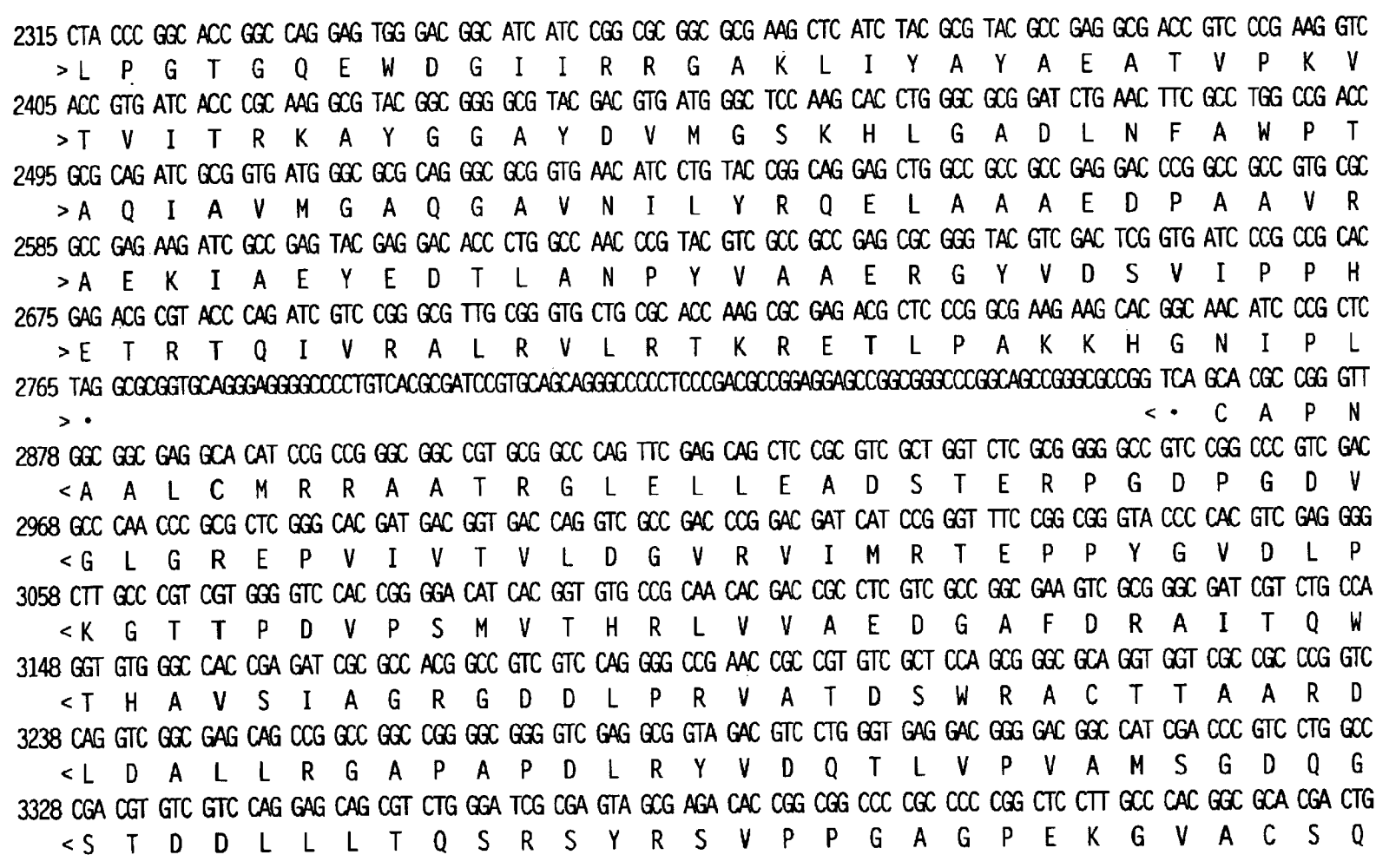
Figure 12D:
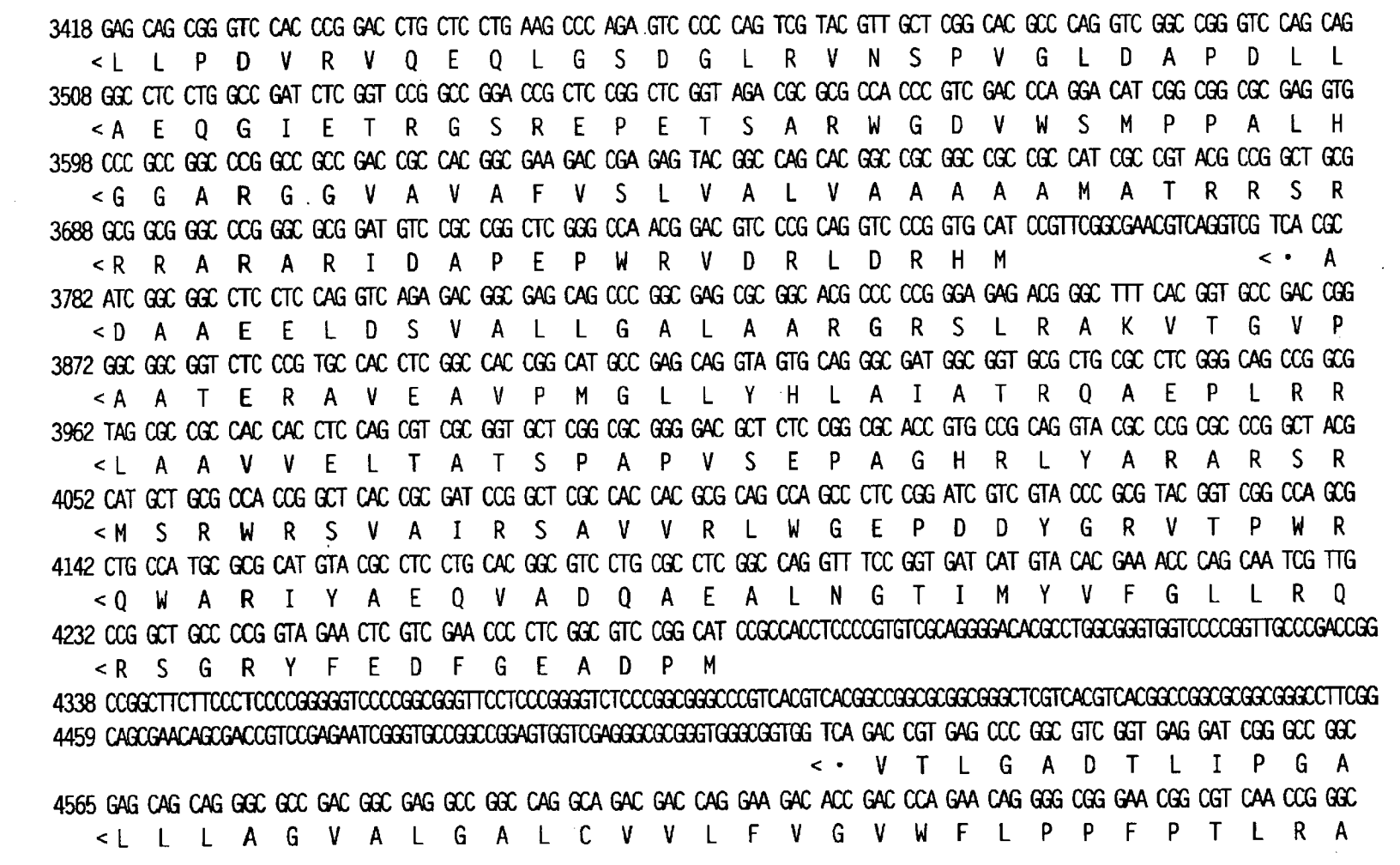
Figure 12E:
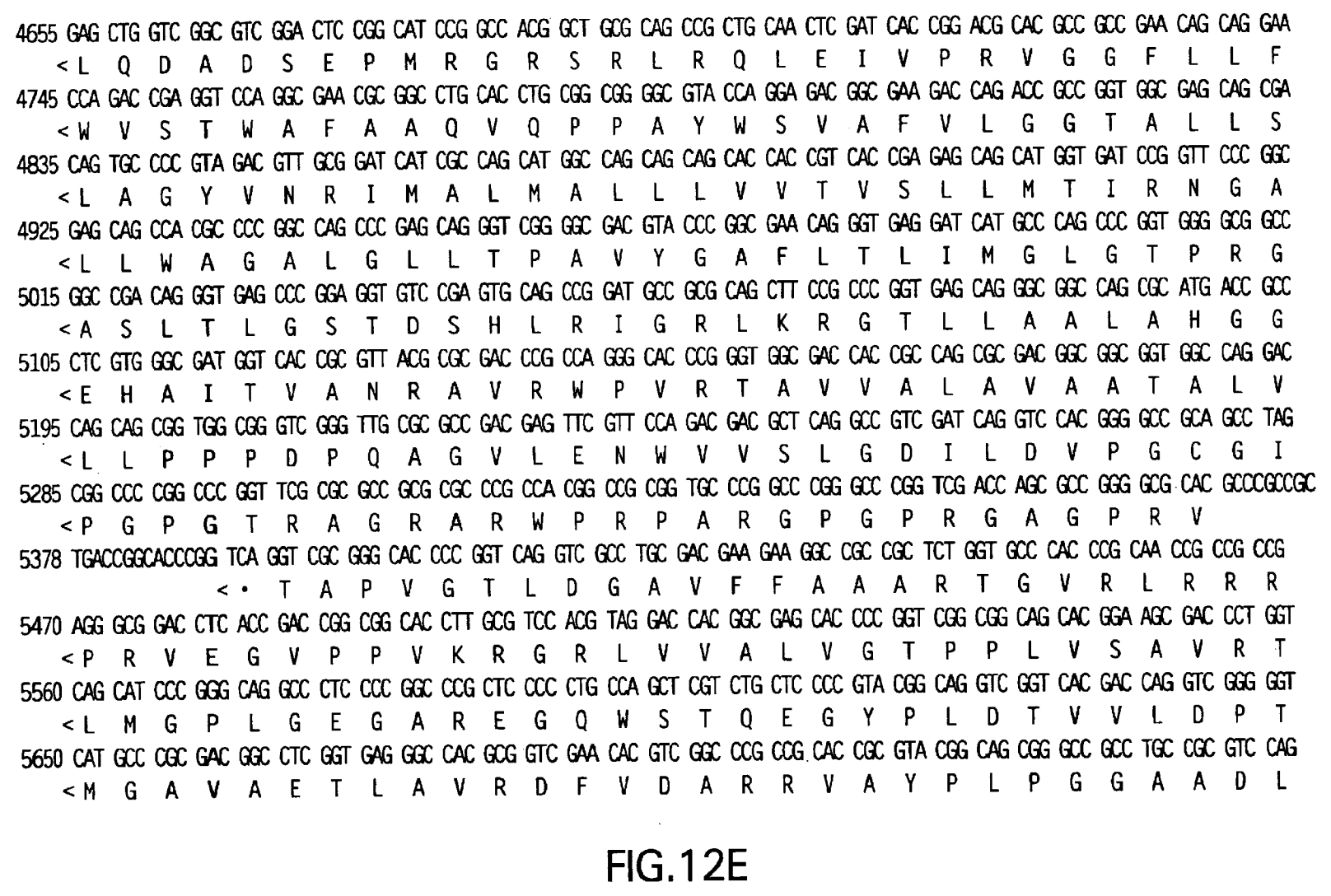
Figure 12G:
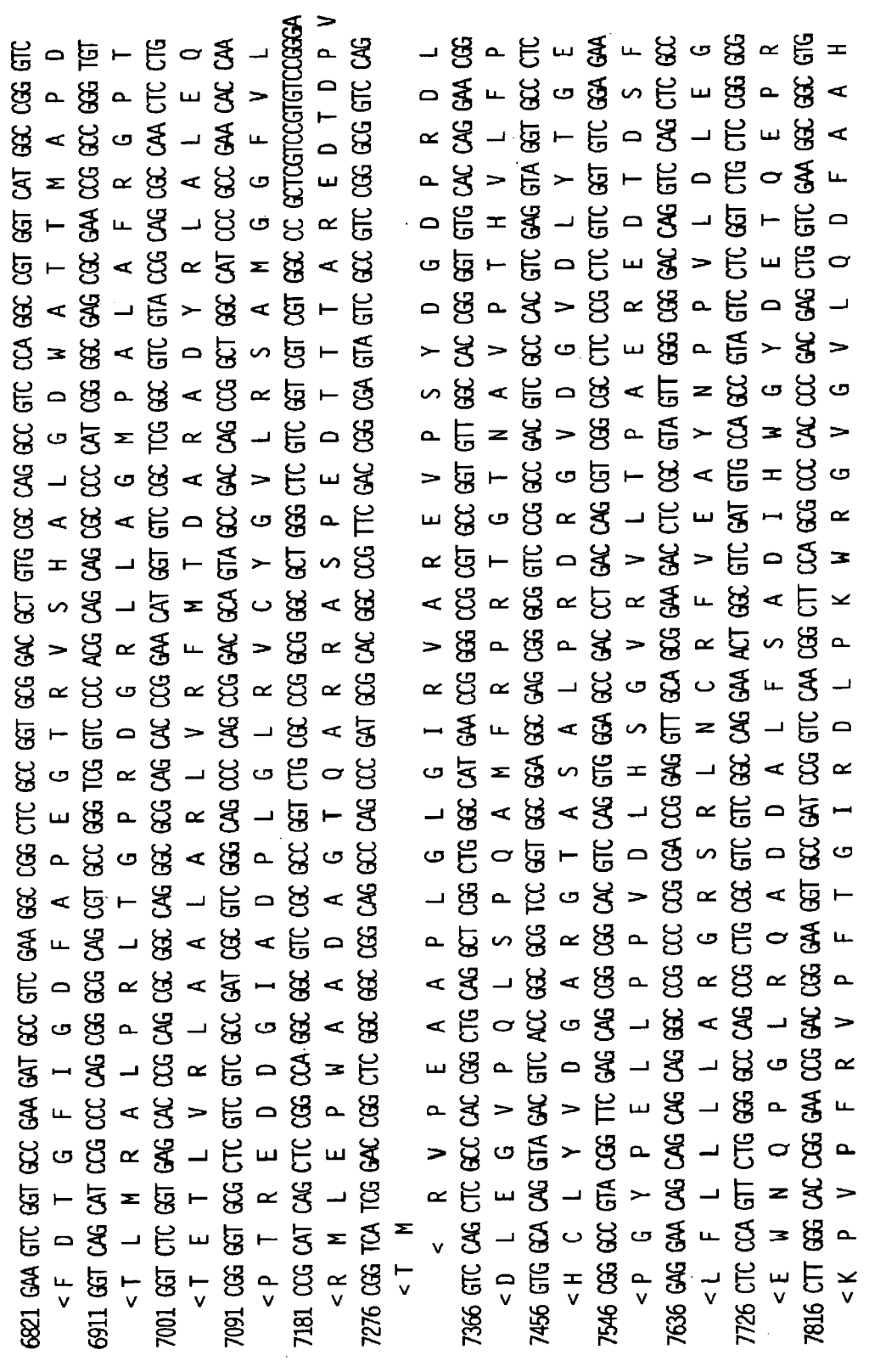
Figure 12H:
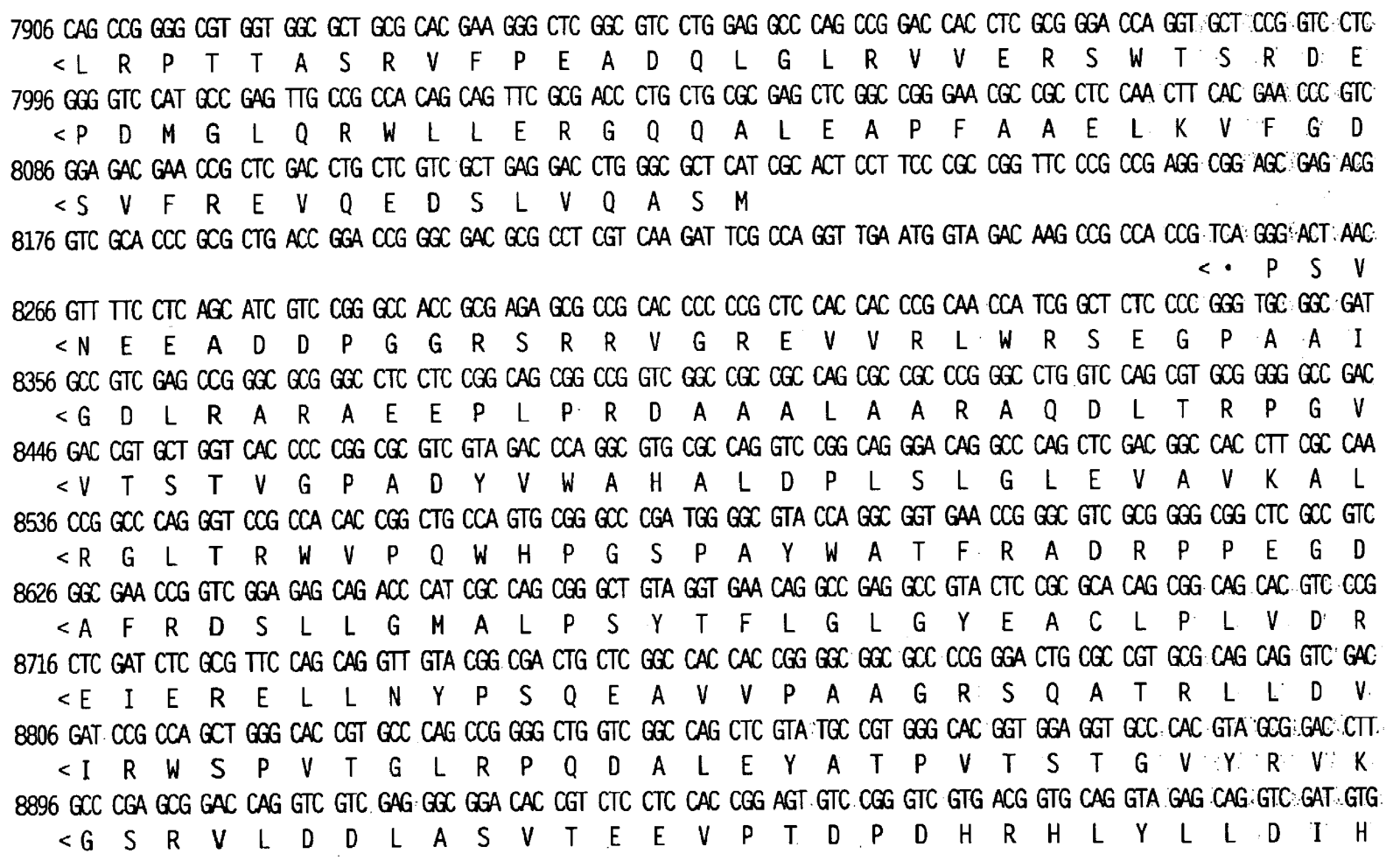
Figure 12J:
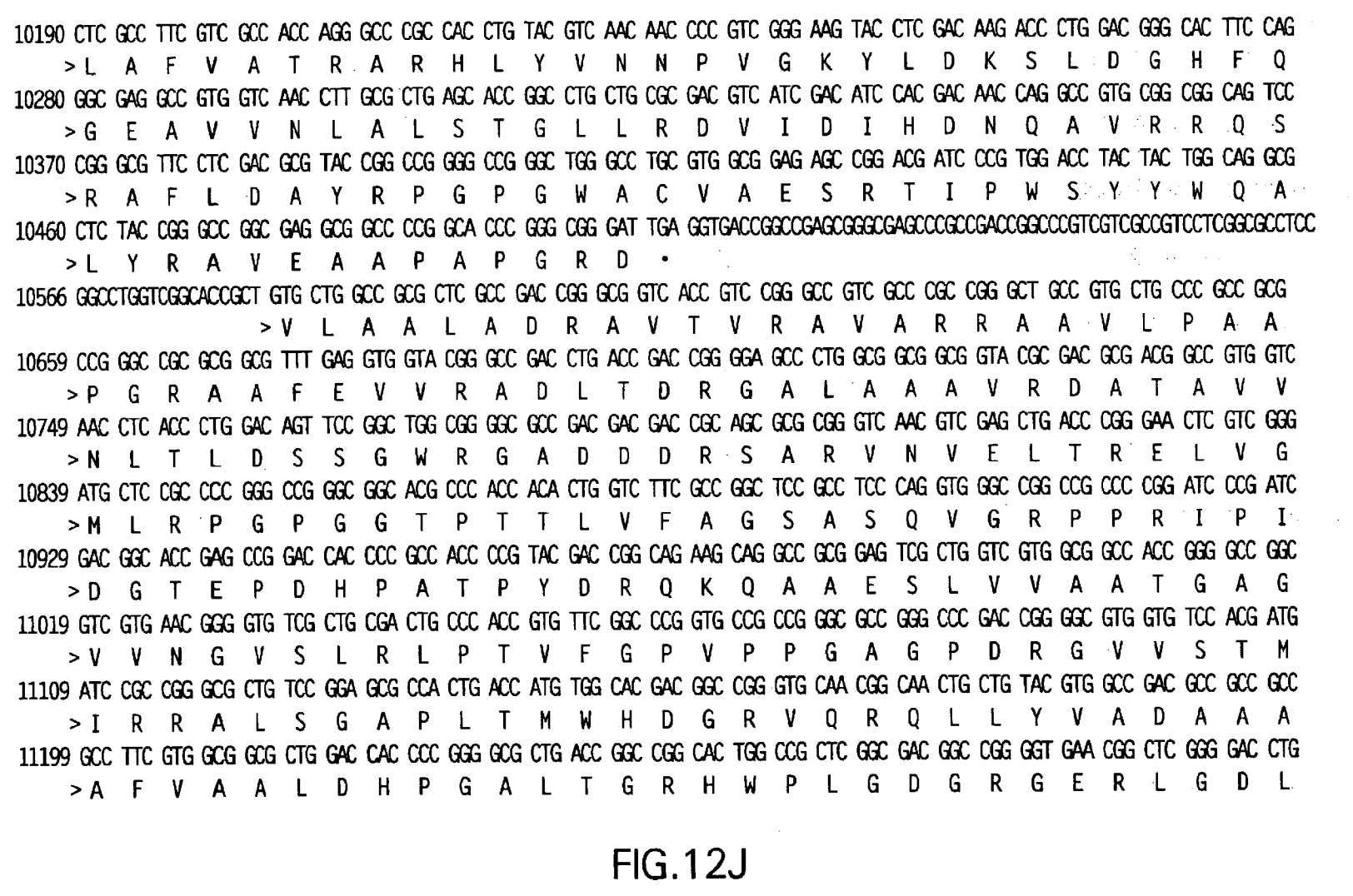

FIGS. 12 A–G. Eveminomicin biosynthetic pathway locus sequence (SEQ ID NO: 182) with open reading frames and deduced amino acid sequences (SEQ II) NOS: 183–204).

DETAILED DESCRIPTION

*Micromonospora carbonacea* var. *africana* produces several antibiotics, including everninomicin, thiostrepton, chloramphenicol and lasilosid. As noted above, the present invention advantageously provides the DNA sequence for the gene cluster responsible for encoding everninomicin biosynthetic genes, which provide the machinery for producing everninomicin. As a result, the present invention provides the information needed to synthesize novel everninomicin-related compounds based on everninomicin, arising from modifications of this DNA sequence designed to change glycosyl and modified orsellinic acid groups contained in everninomicin.

The invention also advantageously provides an *M. carbonacea*-specific integrase gene and integration sites (see, FIGS. 7B, 9A, and 9B). Use of the pMLP1 att/int site specific integration function allows for increasing a given gene dosage and for adding heterologous genes that lead to the formation of new products, such as hybrid antibiotics. This procedure has many advantages over methods involving autonomously replicating plasmids. In particular, a plasmid containing pMLP1 att/int functions would integrate as a single copy per chromosome. Plasmids comprising the site-specific integrating function would introduce the gene of choice into the chromosome of actinomycetes. Vectors lacking actinomycete origins of replication can only exist in their integrated form in actinomycetes. Integrated vectors are extremely stable which allows the gene copies to be maintained without antibiotic selective pressure. The site-specific nature of the integration allows analysis of the integrants.

Figure 1:
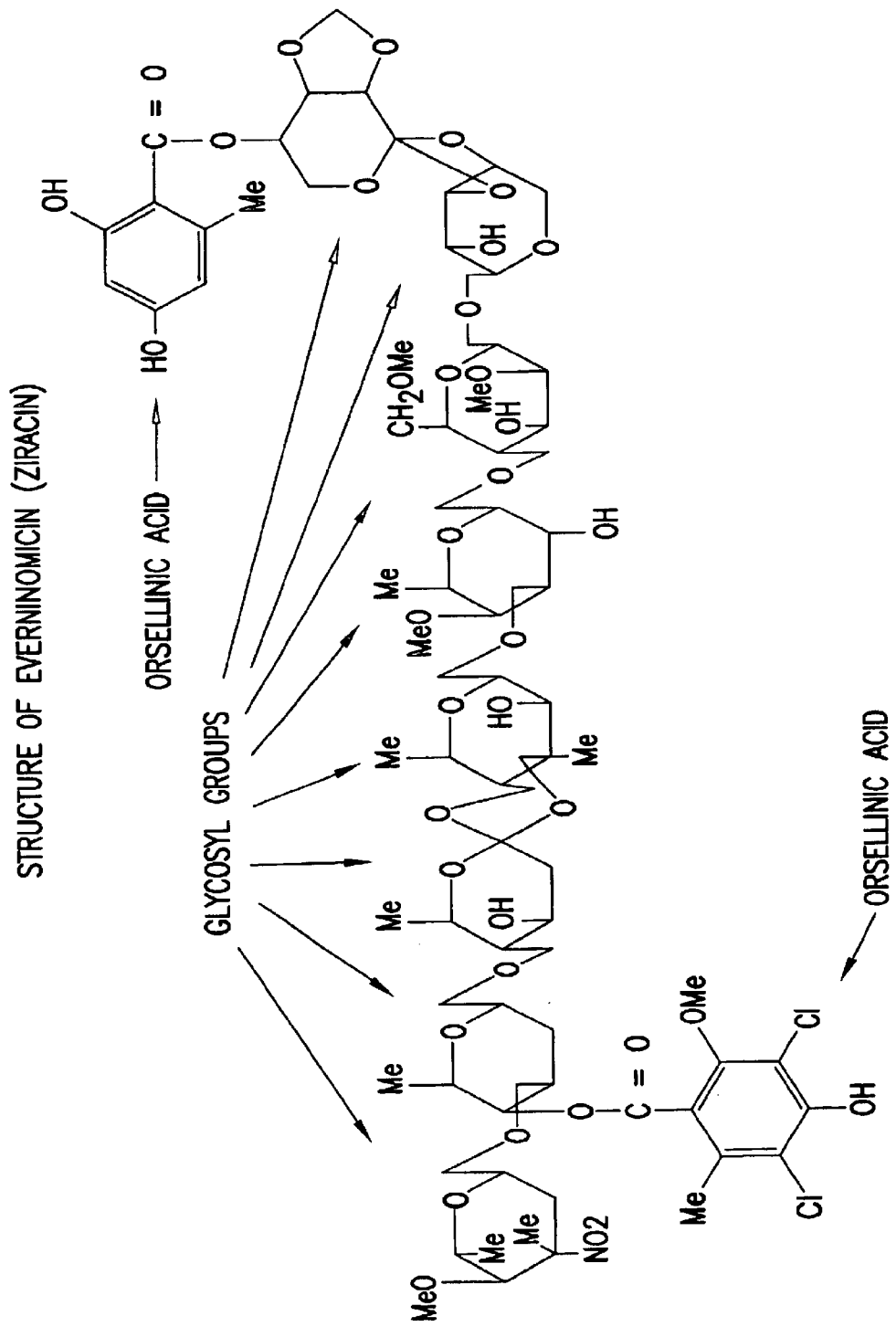
FIG. 1. The structure of everninomicin.

"Everninomicin" refers to a lipophilic oligosaccharide antibiotic of the orthosomycin family of antibiotics, which contain at least one acidic phenolic hydrogen, and two orthoester linkages associated with the glycosy residues (FIG. 1; see, PCT Publication No. WO 93/07904). These include for example everninomicin, curamycin, avilamycin and flambamycins (Ganguly et al., J.C.S. Chemical Communication, 1976, pp. 609–611; "Kirk-Othmer, Encyclopedia of Chemical Technology", Vol 2, 1978, Third Edition, John Wiley and Sons, pp. 205–209; Ollis, et al., Tetrahedron, 1979, 35:105–127). These lipophilic oligosaccharide antibiotics exhibit broad spectrum biological activity against gram positive and some gram negative bacteria in various in vitro assays, and in vivo activity, for example, in animal models such as murine models of gram positive infection.

Figure 2A:
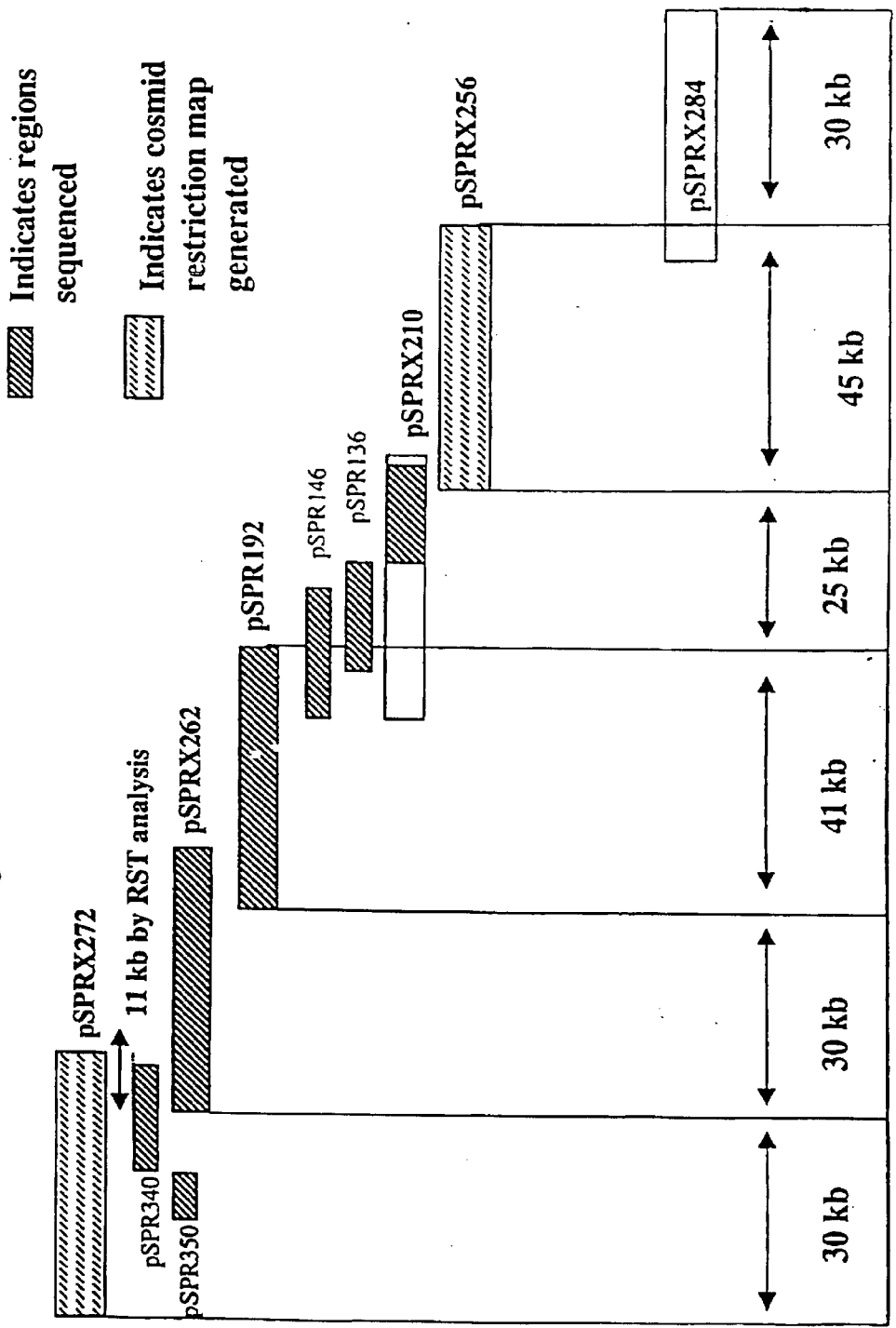
FIGS. 2A–C. (A) Map of cosmid clones and subclones that span the whole region of the everninomicin biosynthetic locus and surrounding genomic DNA. Heavy cross-hatching indicates sequenced regions; light cross-hatching indicates regions for which a cosmid restriction map was obtained. (B) Restriction map of cosmid pSPRX272. (C) Restriction map of cosmid pSPRX256. In (B) and (C), cross-hatched regions have been sequenced and cloned fragments are indicated by clone designations beneath the fragment.

An "everninomicin (EV) biosynthetic pathway gene product" from a *Micromonospora carbonacea* refers to any enzyme ("EV biosynthetic enzyme") involved in the biosynthesis of everninomicin. These genes are located in the EV biosynthetic locus on the *M. carbonacea* chromosome. This locus is depicted in FIGS. 2A and 3. Since everninomicin is only known to be produced in *M. carbonacea*, for the sake of particularity the EV biosynthetic pathway is associated with this microorganism. However, it should be understood that this term encompasses EV biosynthetic enzymes (and genes encoding such enzymes) isolated from any *M. carbonacea*, and furthermore that these genes may have novel homologues in related actinomycete bacteria that fall within the scope of the claims here. In specific embodiments, these genes are depicted in FIG. 11 (SEQ ID NO:1; open reading frames and polypeptides designated as SEQ ID NOS: 2–175) and FIG. 12 (SEQ ID NO: 182; open reading frames and polypeptides designated as SEQ ID NOS: 183–204). It is noted that the sequences of FIGS. 11 and 12 are linked (contiguous) or connected such that they are part of the same cluster, i.e., the sequence in FIG. 12 precedes that of FIG. 11. Moreover, the present inventors have identified specific categories into which many of the genes from the EV biosynthetic pathway fall, including but by no means limited to, orsellinic acid biosynthetic enzymes, sugar biosynthetic enzymes, glycosyltransferases, tailoring enzymes, regulatory enzymes (serine-threonine kinases), and resistance mechanism enzymes (rRNA methylases and transporter enzymes). These categories are discussed in greater detail, infra. The gene products are listed in Tables 1a and 1b.

TABLE 1a

Gene Products and Putative Enzymatic Functions Involved in Everninomicin Production

| Gene Product | CDS[1] | RBS[2] | SEQ ID NO.[4] | Enzymatic Function (Protein ACC No; BLAST Score) | Class |
|---|---|---|---|---|---|
| evdA length 416aa | (132 . . . 1382)* | (1389 . . . 1394)* | 2, 3 | Similarity to hydroxylase (CAA11782; 6.5e–137) | sugar biosynthetic |
| evdB length 373aa | (1490 . . . 2611)* | (2618 . . . 2622)* | 4, 5 | Hexose aminotransferase, dnrJ homolog (daunorubicin) (P25048; 2.8e–65) | sugar NH2 addition |
| evdC length 412aa | (2622 . . . 3860)* | (3867 . . . 3870)* | 6, 7 | Similar to flavoprotein, oxidase (S39965; 4.4e–92) | sugar biosynthetic |
| evdD length 389aa | (4143 . . . 5312) | (4134 . . . 4138) | 8, 9 | DNTP-hexose glycosyltransferase (AAC01731; 4.6e–49) | Glycosyl transfer |
| evdE length 308aa | (5309 . . . 6235) | | 10, 11 | hexose dehydratase (CAA18814; 8.0e–58) | sugar biosynthetic |
| evdF length 347aa | (6232 . . . 7275) | (6226 . . . 6229) | 12, 13 | dNTP-hexose glycosyltransferase (CAB07092; 3.4e–18) | Glycosyl transfer |
| evdG length 351aa | (7272 . . . 8327) | | 14, 15 | unknown | unknown |
| evdH length 340aa | (8342 . . . 9364) | (8333 . . . 8336) | 16, 17 | dNTP-hexose glycosyltransferase (CAA19930; 0.8) | Glycosyl transfer |
| evdI length 253aa | (9463 . . . 10,224)* | (10,232 . . . 10,235)* | 18, 19 | hydrolase (AAB81835; 6.8e–10) | sugar biosynthetic |
| evdJ length 250aa | (10,424 . . . 11,176) | | 20, 21 | unknown | unknown |
| evdK length 415aa | (11,208 . . . 12,455) | | 22, 23 | hexose dehydratase or empimerase (CAB08849; 3.3e–26) | sugar biosynthetic |
| evdL | (12,108 . . . 13,022)* | (13,027 . . . 13,030)* | 24, 25 | dNTP-hexose | Glycosyl |

TABLE 1a-continued

Gene Products and Putative Enzymatic Functions Involved in Everninomicin Production

| Gene Product | CDS[1] | RBS[2] | SEQ ID NO.[4] | Enzymatic Function (Protein ACC No; BLAST Score) | Class |
|---|---|---|---|---|---|
| length 304aa | | | | glycosyltransferase (S37028; 0.010) | transfer |
| evrA length 317aa | (14,410 ... 15,363)* | (15,369 ... 15,373)* | 26, 27 | hexose epimerase (CAA12010.1; 1.3e−40) | sugar biosynthetic |
| evrB length 344aa | (15,380 ... 16,414)* | | 28, 29 | hexose oxidoreductase (ACC01734; 1.3e−65) | sugar biosynthetic |
| evrC length 484aa | (16,419 ... 17,873)* | | 30, 31 | hexose dehydratase (CAA12009; 2.2e−107) | sugar biosynthetic |
| evrD length 354aa | (17,870 ... 18,934)* | | 32, 33 | GDP-mannose 4,6-dehydratase (BAA16585; 1.0e−88) | sugar biosynthetic |
| evrE length 510aa | (19,374 ... 20,906) | | 34, 35 | multidrug efflux transporter (CAB15277; 1.4e−59) | resistance mechanism |
| evrF length 492aa | (21,064 ... 22,542) | (21,056 ... 22,542) | 36, 37 | similar to non-heme oxygenate/halogenase (CAA11780; 4.3e−58) | orsellinic acid chlorine addition |
| evrG length 474aa | (22,748 ... 24,172) | (22,736 ... 22,740) | 38, 39 | oxidase (Q12737; 5.5e−67) | tailoring |
| evrH length 348aa | (24,177 ... 25,223)* | (25,230 ... 25,233)* | 40, 41 | unknown (AAB89073; 3.2e−6) | unknown |
| evrI length 358aa | (25,550 ... 26,626) | | 42, 43 | acyl starter unit fidelity (daunorubicin homology) (AAA65208; 5.7e−56) | PKS acyl Carbon choice |
| evrJ length 1264aa | (26,685 ... 30,479) | (26,672 ... 26,676) | 44, 45 | orsellinic acid synthase 6-methylsalicilic acid synthetase (CAA72713; 0.0e) | polyketide synthetase |
| evrK length 439aa | (30,557 ... 31,876)* | (31,885 ... 31,888)* | 46, 47 | Na/H antiporter (BAA16991; 2.1e−14) | unknown |
| evrL length 313aa | (31,941 ... 32,882)* | | 48, 49 | similar to gene essential to heme biosynthesis (BAA12681; 0.0012) | unknown |
| evrM length 412aa | (33,167 ... 34,405)* | (34,414 ... 34,418)* | 50, 51 | similar to p450 hydroxylase (S18530; 3.8e−70) | tailoring |
| evrN length 253aa | (34,449 ... 35,210)* | (35,219 ... 35,221)* | 52, 53 | methyl transferase (CAB10751; 0.00061) | tailoring |
| evrO length 314aa | (35,294 ... 36,238)* | | 54, 55 | unknown (BAA20094; 0.56) | unknown |
| evrP length 242aa | (36,235 ... 36,963)* | | 56, 57 | unknown (CAB05421; 0.00020) | unknown |
| evrQ length 342aa | (36,998 ... 38,026)* | | 58, 59 | similar to oxidoreductase and heat stress protein (P80874; 7.8e−31) | tailoring |
| evrR length 164aa | (38,072 ... 38,566)* | | 60, 61 | low similarity to hexaheme nitrite reductase regulator (P30866; 0.0034) | regulatory (methyl transferase) |
| evrS length 423aa | (38,892 ... 40,163)* | | 62, 63 | dNTP-hexose glycosyltransferase (AAD15267; 1.9e−36) | Glycosyl transfer |
| evrT length 224aa | (40,216 ... 40,890)* | (40,899 ... 40,902)* | 64, 65 | similar to L-proline hydroxylase (BAA20094; 5.5e−7) | tailoring |
| evrU length 229aa | (40,887 ... 41,576)* | | 66, 67 | methyltransferase (CAB02029; 5.6e−6) | tailoring |
| evrV length 342aa | (41,679 ... 42,707)* | (42,714 ... 42,717)* | 68, 69 | dTDP-glucose epimerase (AAB84886; 3.5e−36) | L-dTDP-glucose biosynthetic |
| evrW length 329aa | (42,810 ... 43,799)* | (43,807 ... 43,811)* | 70, 71 | dTDP-glucose dehydratase (CAA72715; 5.1e−136) | D-dTDP-glucose biosynthetic (GDH) |
| evrX | (43,799 ... 44,866)* | | 72, 73 | dTDP-glucose synthetase | D-dTDP-glucose |

TABLE 1a-continued

Gene Products and Putative Enzymatic Functions Involved in Everninomicin Production

| Gene Product | CDS[1] | RBS[2] | SEQ ID NO.[4] | Enzymatic Function (Protein ACC No; BLAST Score) | Class |
|---|---|---|---|---|---|
| length 355aa | | | | (A26984; 1.2e–118) | biosynthetic |
| evrY length 248aa | (45,014 ... 45,760)* | (45,767 ... 45,770)* | 74, 75 | dehalogenase (P24069; 5.8e–8) | drug resistance |
| evrZ length 250aa | (45,962 ... 46,714)* | (45,952 ... 45,956)* | 76, 77 | similar to muramidase/lysozyme (P25310; 1.2e–77) | drug resistance |
| evsA length 692aa | (47,156 ... 49,234)* | | 78, 79 | serine threonine kinase (BAA32455; 2.0e–76) | regulatory |
| evsB length 363aa | (51,627 ... 52,715) | (51,620 ... 51,622) | 80, 81 | similar to proteases | unknown |
| evsC length 222aa | (52,889 ... 53,557) | | 82, 83 | similar to MAF involved in septum formation (BAA18425; 1.3e–21) | unknown |
| evbA length 217aa | (53,554 ... 54,207) | | 84, 85 | O-methyl transferase (AAC44130; 8.6e–38) | tailoring; possible resistance |
| evbB length 251aa | (54,362 ... 55,117)* | (55,125 ... 55,128)* | 86, 87 | membrane pump, homolog mithramicin resistance (AAC443581; 2.9e–24) | resistance mechanism |
| evbC length 319aa | (55,135 ... 56,094)* | (56,100 ... 56,103)* | 88, 89 | membrane pump, homolog mithramicin resistance (AAC44357; 1.0e–69) | resistance mechanism |
| evbC2 length 198aa | (56,184 ... 56,813)* | | 90, 91 | ankrylin like (AAC44356; 0.0041) | resistance |
| evbD length 582aa | (56,961 ... 58,709) | (56,947 ... 56,951) | 92, 93 | acyl-CoA carboxylase (CAB07068; 7.3e–201) | malonyl-CoA biosynthesis |
| evbE length 479aa | (58,873 ... 60,312) | | 94, 95 | IMP dehydrogenase (CAA15452; 4.1e–165) | tailoring |
| evbF length 185aa | (60,472 ... 61,029)* | (61,038 ... 61,040)* | 96, 97 | hypothetical protein Rv0653c, mycobacterium (CAB07128; 3.8e–06) | regulator |
| evbF1 length 90aa | (61,288 ... 61,560) | | 98, 99 | unknown | unknown |
| evbF2 length 152aa | (61,610 ... 62,069) | (61,597 ... 61,599) | 100, 101 | ORFI *Streptomyces peucetius* (CAA06602; 0.024) | regulatory/ resistance |
| evbG length 557aa | (62,122 ... 63,795) | | 102, 103 | ABC transporter (Q11046; 2.7e–170) | drug resistance |
| evbH length 645aa | (63,891 ... 65,828) | (63,884 ... 63,887) | 104, 105 | ABC transporter (Q11047; 5.6e–166) | drug resistance |
| evbI length 467aa | (66,469 ... 67,872)* | (67,883 ... 67,886)* | 106, 107 | lipoamide dehydrogenase (CAA17075; 1.6e–140) | tailoring |
| evbJ length 151aa | (67,979 ... 68,434) | | 108, 109 | hypothetical protein Rv3304 [*Mycobacterium tuberculosis*] (CAA17076; 7.6e–40) | unknown |
| evbK length 321aa | (68,529 ... 69,494) | | 110, 111 | protease synthase and sporulation regulator; homology to resistance proteins streptomyces (O29729; 7.3–7) | regulatory |
| evbL length 249aa | (69,610 ... 70,359)* | | 112, 113 | acetyltransferase/ phosphotransferase | tailoring |
| evbM length 306aa | (70,365 ... 71,285)* | | 114, 115 | hypothetical protein Rv 1584c [*Mycobacterium tuberculosis*] (CAB09085; 0.32) | unknown |
| evbN length 209aa | (71,289 ... 71,918)* | (71,926 ... 71,929)* | 116, 117 | hypothetical protein SC3A7.08 [*S. coelicolor*] (CAA20071; 4.0e–40) | unknown |
| evbO | (72,284 ... 72,979) | | 118, 119 | putative lipoprotein [S. | unknown |

TABLE 1a-continued

Gene Products and Putative Enzymatic Functions Involved in Everninomicin Production

| Gene Product | CDS[1] | RBS[2] | SEQ ID NO.[4] | Enzymatic Function (Protein ACC No; BLAST Score) | Class |
|---|---|---|---|---|---|
| length 230aa | | | | coelicolor] (CAA19252; 2.6e−20) | |
| evbP length 420aa | (72,933 ... 74,195)* | | 120, 121 | peptidase (CAA17077; 6.5e−88) | unknown |
| evbQ length 527aa | (74,707 ... 76,290)* | | 122, 123 | methylmalonyl-Coa mutase (BAA30410; 1.8e−149) | acyl precursor biosynthesis |
| evbR length 696aa | (76,622 ... 78,712) | | 124, 125 | protein serine/threonine kinase note eukaryotic type (BAA32455; 1.1e−71) | regulatory |
| evbS length 576aa | (78,791 ... 80,521) | | 126, 127 | phosphomannomutase (CAA17080; 5.4e−91) | sugar biosynthesis |
| evbT length 286aa | (82,073 ... 82,933) | | 128, 129 | hypothetical protein SC5C7.22c (CAA20634; 5.7e−28) | 10–28 |
| evbU length 202aa | (83,280 ... 83,888)* | | 130, 131 | glucose-6-phosphate 1-dehydrogenase low BLAST homology (S61167; 0.00039) | unknown |
| evbV length 193aa | (84,080 ... 84,661)* | | 132, 133 | uracil phosphoribosyl transferase (CAA17081; 5.6e−60) | unknown |
| evbW length 338aa | (84,890 ... 85,906)* | | 134, 135 | deoxyribose-phosphate aldolase (AAA79343; 1.3e−54) | unknown |
| evbX length 477aa | (85,909 ... 87,342) | | 136, 137 | aldehyde dehydrogenase (AAB84440; 4.2e−103) | tailoring |
| evbY length 245aa | (87,422 ... 88,159) | (87,407 ... 87,411) | 138, 139 | aldehyde dehydrogenase (CAA71003; 3.4e−16) | tailoring |
| evbZ length 137aa | (88,292 ... 88,705) | (88,280 ... 88,282) | 140, 141 | hypothetical protein (CAB06141; 1.3e−16) | unknown |
| evcA length 301aa | (88,716 ... 89,621) | | 142, 143 | hypothetical protein, putative integral membrane protein [Streptomyces coelicolor] (CAB06143; 4.5e−28) | unknown |
| evcB length 416aa | (89,817 ... 91,067) | | 144, 145 | cytochrome D oxidase subunit I (P94364; 3.0e−65) | tailoring |
| evcC length 335aa | (91,078 ... 92,085) | (91,068 ... 91,072) | 146, 147 | cytochrome D oxidase subunit II (CAA71118; 1.9e−15) | tailoring |
| evcD length 561aa | (92,148 ... 93,833) | | 148, 149 | ABC transporter (CAA22219; 2.6e−107) | resistance |
| evcE length 613aa | (93,830 ... 95,671) | | 150, 151 | ABC transporter (AAC44070; 3.4e−32) | resistance |
| evcF length 229aa | (95,729 ... 96,418) | | 152, 153 | unknown | unknown |
| evcG length 111aa | (96,440 ... 96,775)* | | 154, 155 | unknown (AAB84787; 1.9e−8) | unknown |
| evcH length 303aa | (96,894 ... 97,805) | | 156, 157 | unknown (CAA17083; 9.2e−5) | unknown |
| evcI search length 691aa | (98,287 ... 100,362) | | 158, 159 | unknown (CAA19992; 6.0e−6) | unknown |
| evcJ length 197aa | (100,733 ... 101,326)* | | 160, 161 | putative ATP/GTP binding protein (CAA19989; 7.9e−59) | unknown |
| evcJ2 length 134aa | (101,328 ... 101,732)* | | 162, 163 | unknown (CAA19986; 8.6e−23) | unknown |
| evcK | (101,803 ... 102,156)* | | 164, 165 | unknown | unknown |

TABLE 1a-continued

Gene Products and Putative Enzymatic Functions Involved in Everninomicin Production

| Gene Product | CDS[1] | RBS[2] | SEQ ID NO.[4] | Enzymatic Function (Protein ACC No; BLAST Score) | Class |
|---|---|---|---|---|---|
| length 117aa | | | | (CAA19991; 1.7e–36) | |
| evcL search length 1145aa | (102,204 . . . 105,641)* | | 166, 167 | unknown (CAA19992; 4.6e–99) | unknown |
| evcM length 201aa | (105,907 . . . 105,641) | | 168, 169 | putitive uridine kinase (CAA19591; 1.0e–9) | unknown |
| evcN length 358aa | (106,513 . . . 107,589) | | 170, 171 | unknown (CAA17085; 7.5e–120) | unknown |
| evrMR length 320aa | (107,653 . . . 108,615) | (107,637 . . . 107,641) | 172, 173 | homology to 23S rRNA methylase for mycinamicin resistance (myrA) (BAA03674; 1.4e–79) | resistance |
| evrMR2 length 193aa | (108,635 . . . 109,216) | | 174, 175 | homology to gene linked to myrA | resistance |

TABLE 1b

Gene Products and Putative Enzymatic Functions Involved in Everninomicin Production

| ORF1 length 291aa | (189–1064)* | (1069–1073) | 183, 184 | Transcriptional regulator Biotinylation H70979; 8e–31 | unknown |
|---|---|---|---|---|---|
| ORF2 length 527aa | (1184–2767)* | | 185, 186 | Propionyl-CoA carboxylase T42208; 0.0e | unknown |
| ORF3 length 296aa | (2863–3753)* | | 187, 188 | unknown | unknown |
| ORF4 length 166aa | (3776–4276)* | (4280–4284) | 189, 190 | ECF sigma factor T36644; 8e–26 | regulation |
| ORF5 length 280aa | (4526–5368)* | | 191, 192 | Membrane protein CAB94598.1; 5e–50 | unknown |
| ORF6 length 251aa | (5392–6147)* | (6152–6156) | 193, 194 | rRNA methyltransferase AAG32067.1; 4e–49 | resistance |
| ORF7 length 362aa | (6194–7282)* | | 195, 196 | O-methyl transferase PP42712; 4e–59 | modification |
| ORF8 length 284aa | (7280–8133) | (8141–8145) | 197, 198 | unknown | unknown |
| ORF9 length 354aa | (8254–9318) | (9324–9328) | 199, 200 | oxidoreductase AAG05128.1; 3e–51 | modification |
| ORF10 length 309aa | (9575–10,504) | (9568–9571) | 201, 202 | unknown | unknown |
| ORF11 Length 333aa | (10,584–11,585) | | 203, 204 | deoxyhexose ketoreductase T17473; 1e–49 | sugar modification |

Legend for Tables 1a and 1b
*CDS, RBS complement on full length biosynthetic locus sequence
[1]CDS is then putative coding sequence.
[2]RBS is the putative ribosome binding site.
[3]GenBank protein database (http://www.ncbi.nih.gov/Entrez/protein.html)

Although the term "enzymes" is used to refer to the EV biosynthetic pathway gene products, such gene products may be proteins with non-enzymatic functions. Such proteins are also contemplated as falling within the scope of the present invention.

An "EV biosynthetic pathway bottleneck gene" is a gene encoding a product whose level limits the rate of synthesis of everninomicin. Examples of such gene products include, though are not limited to, evrJ (involved in orsellinic acid biosynthesis); evrV, evrW, and evrX (involved in dTDP-glucose synthesis); evbD (involved in malonyl-CoA-synthesis, which is required for orsellinic acid synthesis); and oxidases responsible for oxidation of the amino group on the terminal sugar to produce eveminomicin that contains a nitrososugar group. Other likely bottleneck genes include those encoding glycosyltransferases (evdD, evdF, evdH, evdL, and evrS) and tailoring enzymes, particularly sugar modification enzymes.

A modified *Micromonospora carbonacea* refers to a microorganisms that has been genetically engineered to over-express or suppress expression of an EV biosynthetic pathway gene product (enzyme). Such genetic engineering and manipulation is described in detail, infra. Preferably, to increase the level of production of eveminomicin, the modified microorganism overexpresses one or more bottleneck genes. To produce an everninomicin analog or homolog, various tailoring enzyme genes (e.g., evdB, a hexose aminotransferase that produces an amino sugar; evrF, a non-heme halogenase that chlorinates the orsinillic acid; or an oxidase gene that produces a nitrososugar by oxidation of an aniinosugar) may be knocked out. Other knock-outs may be made of putative key genes, resulting in all likelihood in blockage of everninomicin biosynthesis. These include the orsellinic acid synthase (evrJ), dTDP-glucose synthases (evrV, evrW, and evrX), and glycosyltransferases (evdD, evdF, evdH, evdL, and evrS). A knockout of the glycosyltransferase that adds the terminal glycosyl group is expected to produce an everninomicin analog lacking the terminal glycosyl group.

Such genetic construction can be replicated in a different actinomycete, such as a *Streptomyces*, as described infra, by introduction of all or part of the modified everninomicin biosynthetic pathway described here into such a host cell.

A *Micromonospora carbonacea* "everninomicin biosynthetic pathway resistance gene product" is a protein or enzyme that confers resistance to everninomicin (and related compounds) to a host cell. Expression of such a gene on a vector provides an alternative selection mechanism for transformed host cells in vitro or in vivo, and thus can be used in molecular biological manipulations of cells independently of the EV biosynthetic pathway. For example, such a vector can be used to select for a transfected or transformed host cell by culturing the cell in the presence of an amount of everninomicin that is toxic to the host cell lacking the vector.

A *Micromonospora* site-specific Att/Int functions consist of an integrase protein and AttP site, e.g., as depicted in FIG. 7B (SEQ ID NO: 177) and in a specific embodiment encoded by a nucleic acid having a sequence as depicted in FIG. 7B (SEQ ID NO: 176), that permits site-specific integration of a vector into an actinomyce, and particularly a *Micromonospera*, genome.

General Definitions

As used herein, the term "isolated" means that the referenced material is removed from the environment in which it is normally found. Thus, an isolated biological material can be free of cellular components, i.e., components of the cells in which the material is found or produced. In the case of nucleic acid molecules, an isolated nucleic acid includes a PCR product, an isolated mRNA, a cDNA, or a restriction fragment. In another embodiment, an isolated nucleic acid is preferably excised from the chromosome in which it may be found, and more preferably is no longer joined to non-regulatory, non-coding regions, or to other genes, located upstream or downstream of the gene contained by the isolated nucleic acid molecule when found in the chromosome. In yet another embodiment, the isolated nucleic acid lacks one or more introns. Isolated nucleic acid molecules include sequences inserted into plasmids, cosmids, artificial chromosomes, and the like. Thus, in a specific embodiment, a recombinant nucleic acid is an isolated nucleic acid. An isolated protein may be associated with other proteins or nucleic acids, or both, with which it associates in the cell, or with cellular membranes if it is a membrane-associated protein. An isolated organelle, cell, or tissue is removed from the anatomical site in which it is found in an organism. An isolated material may be, but need not be, purified.

The term "purified" as used herein refers to material that has been isolated under conditions that reduce or eliminate the presence of unrelated materials, i.e., contaminants, including native materials from which the material is obtained. For example, a purified protein is preferably substantially free of other proteins or nucleic acids with which it is associated in a cell; a purified nucleic acid molecule is preferably substantially free of proteins or other unrelated nucleic acid molecules with which it can be found within a cell. As used herein, the term "substantially free" is used operationally, in the context of analytical testing of the material. Preferably, purified material substantially free of contaminants is at least 50% pure; more preferably, at least 90% pure, and more preferably still at least 99% pure. Purity can be evaluated by chromatography, gel electrophoresis, immunoassay, composition analysis, biological assay, and other methods known in the art.

Methods for purification are well-known in the art. For example, nucleic acids can be purified by precipitation, chromatography (including preparative solid phase chromatography, oligonucleotide hybridization, and triple helix chromatography), ultracentrifugation, and other means. Polypeptides and proteins can be purified by various methods including, without limitation, preparative disc-gel electrophoresis, isoelectric focusing, HPLC, reversed-phase HPLC, gel filtration, ion exchange and partition chromatography, precipitation and salting-out chromatography, extraction, and countercurrent distribution. For some purposes, it is preferable to produce the polypeptide in a recombinant system in which the protein contains an additional sequence tag that facilitates purification, such as, but not limited to, a polyhistidine sequence, or a sequence that specifically binds to an antibody, such as FLAG and GST. The polypeptide can then be purified from a crude lysate of the host cell by chromatography on an appropriate solid-phase matrix. Alternatively, antibodies produced against the protein or against peptides derived therefrom can be used as purification reagents. Cells can be purified by various techniques, including centrifugation, matrix separation (e.g., nylon wool separation), panning and other immunoselection techniques, depletion (e.g., complement depletion of contaminating cells), and cell sorting (e.g., fluorescence activated cell sorting [FACS]). Other purification methods are possible. A purified material may contain less than about 50%, preferably less than about 75%, and most preferably less than about 90%, of the cellular components with which it was originally associated. The "substantially pure" indicates the highest degree of purity which can be achieved using conventional purification techniques known in the art.

In a specific embodiment, the term "about" or "approximately" means within 20%, preferably within 10%, and more preferably within 5% of a given value or range. Alternatively, especially in biological systems, the term "about" means within about a log (i.e., an order of magnitude) preferably within a factor of two of a given value, depending on how quantitative the measurement.

The use of italics indicates a nucleic acid molecule (e.g., enrJ cDNA, gene, etc.); normal text indicates the polypeptide or protein.

"Sequence-conservative variants" of a polynucleotide sequence are those in which a change of one or more nucleotides in a given codon position results in no alteration in the amino acid encoded at that position.

"Function-conservative variants" are those in which a given amino acid residue in a protein or enzyme has been changed without altering the overall conformation and function of the polypeptide, including, but not limited to, replacement of an amino acid with one having similar properties (such as, for example, polarity, hydrogen bonding potential, acidic, basic, hydrophobic, aromatic, and the like). Amino acids with similar properties are well known in the art. For example, arginine, histidine and lysine are hydrophilic-basic amino acids and may be interchangeable. Similarly, isoleucine, a hydrophobic amino acid, may be replaced with leucine, methionine or valine. Such changes are expected to have little or no effect on the apparent molecular weight or isoelectric point of the protein or polypeptide. Amino acids other than those indicated as conserved may differ in a protein or enzyme so that the percent protein or amino acid sequence similarity between any two proteins of similar function may vary and may be, for example, from 70% to 99% as determined according to an alignment scheme such as by the Cluster Method, wherein similarity is based on the MEGALIGN algorithm. A "function-conservative variant" also includes a polypeptide or enzyme which has at least 60% amino acid identity as determined by BLAST or FASTA algorithms, preferably at least 75%, most preferably at least 85%, and even more preferably at least 90%, and which has the same or substantially similar properties or functions as the native or parent protein or enzyme to which it is compared.

The terms "mutant" and "mutation" mean any detectable change in genetic material, e.g. DNA, or any process, mechanism, or result of such a change. This includes gene mutations, in which the structure (e.g. DNA sequence) of a gene is altered, any gene or DNA arising from any mutation process, and any expression product (e.g. protein or enzyme) expressed by a modified gene or DNA sequence. The term "variant" may also be used to indicate a modified or altered gene, DNA sequence, enzyme, cell, etc., i.e., any kind of mutant.

As used herein, the term "homologous" in all its grammatical forms and spelling variations refers to the relationship between proteins that possess a "common evolutionary origin," including proteins from superfamilies (e.g., the immunoglobulin superfamily) and homologous proteins from different species (e.g., myosin light chain, etc.) (Reeck et al., Cell 50:667, 1987). Such proteins (and their encoding genes) have sequence homology, as reflected by their sequence similarity, whether in terms of percent similarity or the presence of specific residues or motifs at conserved positions.

Accordingly, the term "sequence similarity" in all its grammatical forms refers to the degree of identity or correspondence between nucleic acid or amino acid sequences of proteins that may or may not share a common evolutionary origin (see Reeck et al., supra). However, in common usage and in the instant application, the term "homologous," when modified with an adverb such as "highly," may refer to sequence similarity and may or may not relate to a common evolutionary origin.

In a specific embodiment, two DNA sequences are "substantially homologous" or "substantially similar" when the encoded polypeptides are at least 35–40% similar as determined by one of the algorithms disclosed herein, preferably at least about 60%, and most preferably at least about 90 or 95% in a highly conserved domain, or, for alleles, across the entire amino acid sequence. Sequence comparison algorithms include BLAST (BLAST P, BLAST N, BLAST X), FASTA, DNA Strider, the GCG (Genetics Computer Group, Program Manual for the GCG Package, Version 7, Madison, Wis.) pileup program, etc. using the default parameters provided with these algorithms. An example of such a sequence is an allelic or species variant of the specific everninomicin biosynthetic genes of the invention. Sequences that are substantially homologous can be identified by comparing the sequences using standard software available in sequence data banks, or in a Southern hybridization experiment under, for example, stringent conditions as defined for that particular system.

Cloning and Expression of EV Biosynthetic Pathway Genes

The present invention contemplates analysis and isolation, and/or construction, of a gene encoding a functional or mutant EV biosynthetic enzyme, including a full length, or naturally occurring form of an EV biosynthetic enzyme, and any antigenic fragments thereof from any source. It further contemplates expression of functional or mutant EV biosynthetic enzyme protein for evaluation, diagnosis, or, particularly, biosynthesis of everninomicin or other secondary metabolic products.

In accordance with the present invention there may be employed conventional molecular biology, microbiology, and recombinant DNA techniques within the skill of the art. Such techniques are explained fully in the literature. See, e.g., Sambrook, Fritsch & Maniatis, *Molecular Cloning: A Laboratory Manual*, Second Edition (1989) Cold Spring Harbor Laboratory Press, Cold Spring Harbor, N.Y. (herein "Sambrook et al., 1989"); *DNA Cloning: A Practical Approach*, Volumes I and II (D. N. Glover ed. 1985); *Oligonucleotide Synthesis* (M. J. Gait ed. 1984); *Nucleic Acid Hybridization* [B. D. Hames & S. J. Higgins eds. (1985)]; *Transcription And Translation* [B. D. Hames & S. J. Higgins, eds. (1984)]; *Animal Cell Culture* [R. I. Freshney, ed. (1986)]; *Immobilized Cells And Enzymes* [IRL Press, (1986)]; B. ÊPerbal, *A Practical Guide To Molecular Cloning* (1984); F. M. Ausubel et al. (eds.), *Current Protocols in Molecular Biology*, John Wiley & Sons, Inc. (1994).

Molecular Biology-Definitions

"Amplification" of DNA, as used herein, denotes the use of polymerase chain reaction (PCR) to increase the concentration of a particular DNA sequence within a mixture of DNA sequences. For a description of PCR see Saiki et al., Science, 239:487, 1988.

A "nucleic acid molecule" refers to the phosphate ester polymeric form of ribonucleosides (adenosine, guanosine, uridine or cytidine; "RNA molecules"); or deoxyribonucleosides (deoxyadenosine, deoxyguanosine, deoxythymidine, or deoxycytidine; "DNA molecules"); or any phosphoester analogs thereof, such as phosphorothioates and thioesters, in either single stranded form, or a double-stranded helix; or "protein nucleic acids" (PNA) formed by conjugating bases to an amino acid backbone; or nucleic acids containing modified bases, for example thiouracil, thio-guanine and fluoro-uracil. Double stranded DNA-DNA, DNA-RNA and RNA-RNA helices are possible. The term nucleic acid molecule, and in particular DNA or RNA molecule, refers only to the primary and secondary structure of the molecule, and does not limit it to any particular tertiary forms. Thus, this term includes double-stranded DNA found, inter alia, in linear (e.g., restriction fragments) or circular DNA molecules, plasmids, and chromosomes. In discussing the structure of particular double-stranded DNA molecules, sequences may be described herein according to the normal convention of giving only the sequence in the 5' to 3' direction along the nontranscribed strand of DNA (i.e., the strand having a sequence homologous to the mRNA). A "recombinant DNA molecule" is a DNA molecule that has undergone a molecular biological manipulation.

A "polynucleotide" or "nucleotide sequence" is a series of nucleotide bases (also called "nucleotides") in DNA and RNA, and means any chain of two or more nucleotides. A nucleotide sequence typically carries genetic information, including the information used by cellular machinery to make proteins and enzymes. These terms include double or single stranded genomic and cDNA, RNA, any synthetic and genetically manipulated polynucleotide, and both sense and anti-sense polynucleotide (although only sense stands are being represented herein). This includes single- and double-stranded molecules, i.e., DNA-DNA, DNA-RNA and RNA-RNA hybrids.

The polynucleotides herein may be flanked by natural regulatory (expression control) sequences, or may be associated with heterologous sequences, including promoters, internal ribosome entry sites (IRES) and other ribosome binding site sequences, enhancers, response elements, suppressors, signal sequences, polyadenylation sequences, introns, 5'- and 3'-noncoding regions, and the like. The nucleic acids may also be modified by many means known in the art. Furthermore, the polynucleotides herein may also be oligonucleotides modified with a label capable of providing a detectable signal, either directly or indirectly. Exemplary labels include radioisotopes, fluorescent molecules, biotin, and the like.

A "coding sequence" or a sequence "encoding" an expression product, such as a RNA, polypeptide, protein, or enzyme, is a minimum nucleotide sequence that, when expressed, results in the production of that RNA, polypeptide, protein, or enzyme, i.e., the nucleotide sequence encodes an amino acid sequence for that polypeptide, protein or enzyme. A coding sequence for a protein may include a start codon (usually ATG, though as shown herein, alternative start codons can be used) and a stop codon.

The term "gene", also called a "structural gene" means a DNA sequence that codes for a particular sequence of amino acids, which comprise all or part of one or more proteins or enzymes, and may include regulatory (non-transcribed) DNA sequences, such as promoter sequences, which determine for example the conditions under which the gene is expressed. The transcribed region of the gene may include untranslated regions, including a 5'-untranslated region (UTR) and 3'-UTR, as well as the coding sequence.

A "promoter sequence" is a DNA regulatory region capable of binding RNA polymerase in a cell and initiating transcription of a downstream (3' direction) coding sequence. For purposes of defining the present invention, the promoter sequence is bounded at its 3' terminus by the transcription initiation site and extends upstream (5' direction) to include the minimum number of bases or elements necessary to initiate transcription at levels detectable above background. Within the promoter sequence will be found a transcription initiation site (conveniently defined for example, by mapping with nuclease S1), as well as protein binding domains (consensus sequences) responsible for the binding of RNA polymerase.

A coding sequence is "under the control of" or "operably (or operatively) associated with" transcriptional and translational control sequences in a cell when RNA polymerase transcribes the coding sequence into mRNA, which is then trans-RNA spliced (if it contains introns) and translated into the protein encoded by the coding sequence.

The terms "express" and "expression" mean allowing or causing the information in a gene or DNA sequence to become manifest, for example producing a protein by activating the cellular functions involved in transcription and translation of a corresponding gene or DNA sequence. A DNA sequence is expressed in or by a cell to form an "expression product" such as mRNA or a protein. The expression product itself, e.g. the resulting mRNA or protein, may also be said to be "expressed" by the cell. An expression product can be characterized as intracellular, extracellular or secreted. The term "intracellular" means something that is inside a cell. The term "extracellular" means something that is outside a cell. A substance is "secreted" by a cell if it appears in significant measure outside the cell, from somewhere on or inside the cell.

The term "transfection" means the introduction of a heterologous nucleic acid into a host cell. The term "transformation" means the introduction of a heterologous gene, DNA or RNA sequence to a host cell, so that the host cell will express the introduced gene or sequence to produce a desired product. The introduced gene or sequence may also be called a "cloned" or "heterologous" gene or sequence, and may include regulatory or control sequences, such as start, stop, promoter, signal, secretion, or other sequences used by a cell's genetic machinery. The gene or sequence may include nonfunctional sequences or sequences with no known function. A host cell that receives and expresses introduced DNA or RNA has been "transformed" and is a "transformant" or a "clone." The DNA or RNA introduced to a host cell can come from any source, including cells of the same genus or species as the host cell, or cells of a different genus or species.

The terms "vector", "cloning vector" and "expression vector" mean the vehicle by which a DNA or RNA sequence (e.g. a foreign gene) can be introduced into a host cell, so as to transform the host and promote expression (e.g. transcription and translation) of the introduced sequence. Vectors include plasmids, phages, viruses, etc.; they are discussed in greater detail below.

Vectors typically comprise the DNA of a transmissible agent, into which heterologous DNA is inserted. A common way to insert one segment of DNA into another segment of DNA involves the use of enzymes called restriction enzymes that cleave DNA at specific sites (specific groups of nucleotides) called restriction sites. A "cassette" refers to a DNA coding sequence or segment of DNA that codes for an expression product that can be inserted into a vector at defined restriction sites. The cassette restriction sites are designed to ensure insertion of the cassette in the proper reading frame. Generally, foreign DNA is inserted at one or more restriction sites of the vector DNA, and then is carried by the vector into a host cell along with the transmissible vector DNA. A segment or sequence of DNA having inserted or added DNA, such as an expression vector, can also be called a "DNA construct." A common type of vector is a "plasmid", which generally is a self-contained molecule of double-stranded DNA, usually of bacterial origin, that can readily accept additional (foreign) DNA and which can readily introduced into a suitable host cell. A plasmid vector often contains coding DNA and promoter DNA and has one or more restriction sites suitable for inserting foreign DNA. Promoter DNA is a DNA sequence which initiates, regulates, or otherwise mediates or controls the expression of the coding DNA. Promoter DNA and coding DNA may be from the same gene or from different genes, and may be from the same or different organisms. A large number of vectors, including plasmid and fungal vectors, have been described for replication and/or expression in a variety of eukaryotic and prokaryotic hosts. Non-limiting examples include pKK plasmids (Clonetech), pUC plasmids, pET plasmids (Novagen, Inc., Madison, Wis.), pRSET or pREP plasmids (Invitrogen, San Diego, Calif.), or pMAL plasmids (New England Biolabs, Beverly, Mass.), and many appropriate host cells, using methods disclosed or cited herein or otherwise known to those skilled in the relevant art. Recombinant cloning vectors will often include one or more replication systems for cloning or expression, one or more markers for selection in the host, e.g. antibiotic resistance, and one or more expression cassettes.

The term "host cell" means any cell of any organism that is selected, modified, transformed, grown, or used or manipulated in any way, for the production of a substance by the cell, for example the expression by the cell of a gene, a DNA or RNA sequence, a protein or an enzyme. Host cells can further be used for screening or other assays, as described infra. In a preferred aspect, a host cell of the invention is an actinomycete, preferably of the genus *Streptomyces* (e.g., a host cell as described in Ziermann and Betlach, BioTechniques, 1999, 26:106) or alternatively *Micromonospera*. Additional examples include, but are not limited to, the strains *S. pristinaespiralis* (ATCC 25486), *S. antibioticus* (DSM 40868), *S. bikiniensis* (ATCC 11062), *S. parvulus* (ATCC 12434), *S. glauescens* (ETH 22794), *S. actuosus* (ATCC 25421), *S. coelicolor* (A3(2)), *S. ambofaciens, S. lividans, S. griseofuscus, S. limosus*, and the like (see also Smokvina et al., Proceedings, 1:403–407).

The term "expression system" means a host cell and compatible vector under suitable conditions, e.g., for the expression of a protein coded for by foreign DNA carried by the vector and introduced to the host cell. Common expression systems include *E. coli* host cells and plasmid vectors, although the actinomyte host cell expression systems are preferred for biosynthesis of everninomicin and related products.

The term "heterologous" refers to a combination of elements not naturally occurring. For example, heterologous DNA refers to DNA not naturally located in the cell, or in a chromosomal site of the cell. A heterologous gene is a gene in which the regulatory control sequences are not found naturally in association with the coding sequence. In the context of the present invention, an EV biosynthetic enzyme gene is heterologous to the vector DNA in which it is inserted for cloning or expression, and it is heterologous to a host cell containing such a vector, in which it is expressed, e.g., a K562 cell.

A nucleic acid molecule is "hybridizable" to another nucleic acid molecule, such as a cDNA, genomic DNA, or RNA, when a single stranded form of the nucleic acid molecule can anneal to the other nucleic acid molecule under the appropriate conditions of temperature and solution ionic strength (see Sambrook et al., supra). The conditions of temperature and ionic strength determine the "stringency" of the hybridization. For preliminary screening for homologous nucleic acids, low stringency hybridization conditions, corresponding to a $T_m$ (melting temperature) of 55° C., can be used, e.g., 5×SSC, 0.1% SDS, 0.25% milk, and no formamide; or 30% formamide, 5×SSC, 0.5% SDS). Moderate stringency hybridization conditions correspond to a higher $T_m$, e.g., 40% formamide, with 5× or 6×SCC. High stringency hybridization conditions correspond to the highest $T_m$, e.g., 50% formamide, 5× or 6×SCC. SCC is a 0.15M NaCl, 0.015M Na-citrate. Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of $T_m$ for hybrids of nucleic acids having those sequences. The relative stability (corresponding to higher $T_m$) of nucleic acid hybridizations decreases in the following order: RNA:RNA, DNA:RNA, DNA:DNA. For hybrids of greater than 100 nucleotides in length, equations for calculating $T_m$ have been derived (see Sambrook et al., supra, 9.50–9.51). For hybridization with shorter nucleic acids, i.e., oligonucleotides, the position of mismatches becomes more important, and the length of the oligonucleotide determines its specificity (see Sambrook et al., supra, 11.7–11.8). A minimum length for a hybridizable nucleic acid is at least about 10 nucleotides; preferably at least about 15 nucleotides; and more preferably the length is at least about 20 nucleotides.

In a specific embodiment, the term "standard hybridization conditions" refers to a $T_m$ of 55° C., and utilizes conditions as set forth above. In a preferred embodiment, the $T_m$ is 60° C.; in a more preferred embodiment, the $T_m$ is 65° C. In a specific embodiment, "high stringency" refers to hybridization and/or washing conditions at 68° C. in 0.2× SSC, at 42° C. in 50% formamide, 4×SSC, or under conditions that afford levels of hybridization equivalent to those observed under either of these two conditions.

As used herein, the term "oligonucleotide" refers to a nucleic acid, generally of at least 10, preferably at least 15, and more preferably at least 20 nucleotides, preferably no more than 100 nucleotides, that is hybridizable to a genomic DNA molecule, a cDNA molecule, or an mRNA molecule encoding a gene, mRNA, cDNA, or other nucleic acid of interest. Oligonucleotides can be labeled, e.g., with $^{32}$P-nucleotides or nucleotides to which a label, such as biotin, has been covalently conjugated. In one embodiment, a labeled oligonucleotide can be used as a probe to detect the presence of a nucleic acid. In another embodiment, oligonucleotides (one or both of which may be labeled) can be used as PCR primers, either for cloning full length or a fragment of EV biosynthetic enzyme, or to detect the presence of nucleic acids encoding EV biosynthetic enzyme. In a further embodiment, an oligonucleotide of the invention can form a triple helix with a EV biosynthetic enzyme DNA molecule. Generally, oligonucleotides are prepared synthetically, preferably on a nucleic acid synthesizer. Accordingly, oligonucleotides can be prepared with non-naturally occurring phosphoester analog bonds, such as thioester bonds, etc.

EV Biosynthetic Pathway Nucleic Acids

A gene encoding EV biosynthetic enzyme can be isolated from any everninomicin-producing *Micromonospora* source. Methods for obtaining EV biosynthetic enzyme gene are well known in the art, as described above (see, e.g., Sambrook et al., 1989, supra). The DNA may be obtained by standard procedures known in the art from cloned DNA, by chemical synthesis, by cDNA cloning, or by the cloning of genomic DNA (e.g., DNA having a sequence as deposited with the ATCC and accorded accession no. 39149), or fragments thereof, purified from the desired cell (see, for example, Sambrook et al., 1989, supra; Glover, D. M. (ed.), 1985, DNA Cloning: A Practical Approach, MRL Press, Ltd., Oxford, U.K. Vol. I, II). Whatever the source, the gene can be molecularly cloned into a suitable vector for propagation of the gene. Identification of the specific DNA fragment containing the desired EV biosynthetic enzyme gene may be accomplished in a number of ways. For example, a portion of an EV biosynthetic enzyme gene exemplified infra can be purified and labeled to prepare a labeled probe, and the generated DNA may be screened by nucleic acid hybridization to the labeled probe (Benton and Davis, Science, 1977, 196:180; Grunstein and Hogness, Proc. Natl. Acad. Sci. U.S.A., 1975, 72:3961). Those DNA fragments with substantial homology to the probe, such as an allelic variant from another species, will hybridize. In a specific embodiment, highest stringency hybridization conditions are used to identify a homologous EV biosynthetic enzyme gene.

Further selection can be carried out on the basis of the properties of the gene, e.g., if the gene encodes a protein product having the isoelectric, electrophoretic, amino acid composition, partial or complete amino acid sequence, antibody binding activity, or ligand binding profile of EV biosynthetic enzyme protein as disclosed herein. Thus, the presence of the gene may be detected by assays based on the physical, chemical, immunological, or functional properties of its expressed product.

Other DNA sequences which encode substantially the same amino acid sequence as an EV biosynthetic enzyme gene may be used in the practice of the present invention. These include but are not limited to allelic variants, species variants, sequence conservative variants, and functional variants.

The genes encoding EV biosynthetic enzyme derivatives and analogs of the invention can be produced by various methods known in the art. The manipulations which result in their production can occur at the gene or protein level. For example, the cloned EV biosynthetic enzyme gene sequence can be modified by any of numerous strategies known in the art (Sambrook et al., 1989, supra). The sequence can be cleaved at appropriate sites with restriction endonuclease(s), followed by further enzymatic modification if desired, isolated, and ligated in vitro. In the production of the gene encoding a derivative or analog of EV biosynthetic enzyme, care should be taken to ensure that the modified gene remains within the same translational reading frame as the EV biosynthetic enzyme gene, uninterrupted by translational stop signals, in the gene region where the desired activity is encoded, unless the gene will be used to knock-out or disrupt an endogenous EV biosynthetic enzyme.

Additionally, the EV biosynthetic enzyme-encoding nucleic acid sequence can be mutated in vitro or in vivo, to create and/or destroy translation, initiation, and/or termination sequences, or to create variations in coding regions and/or form new restriction endonuclease sites or destroy preexisting ones, to facilitate further in vitro modification. Such modifications can also be made to introduce restriction sites and facilitate cloning the EV biosynthetic enzyme gene into an expression vector. Any technique for mutagenesis known in the art can be used, including but not limited to, in vitro site-directed mutagenesis (Hutchinson, C., et al., J. Biol. Chem., 1978, 253:6551; Zoller and Smith, DNA, 1984, 3:479–488; Oliphant et al., Gene 1986, 44:177; Hutchinson et al., Proc. Natl. Acad. Sci. U.S.A., 1986, 83:710), use of TAB" linkers (Pharmacia), etc. PCR techniques are preferred for site directed mutagenesis (see Higuchi, "Using PCR to Engineer DNA", in PCR Technology: *Principles and Applications for DNA Amplification*, H. Erlich, ed., Stockton Press, 1989, Chapter 6, pp. 61–70).

The identified and isolated gene can then be inserted into an appropriate cloning vector. A large number of vector-host systems known in the art may be used. Possible vectors include, but are not limited to, plasmids or modified viruses, but the vector system must be compatible with the host cell used. Examples of vectors include, but are not limited to, *E. coli*, bacteriophages such as lambda derivatives, or plasmids such as pBR322 derivatives or pUC plasmid derivatives, e.g., pGEX vectors, pmal-c, pFLAG, etc. The insertion into a cloning vector can, for example, be accomplished by ligating the DNA fragment into a cloning vector which has complementary cohesive termini. However, if the complementary restriction sites used to fragment the DNA are not present in the cloning vector, the ends of the DNA molecules may be enzymatically modified. Alternatively, any site desired may be produced by ligating nucleotide sequences (linkers) onto the DNA termini; these ligated linkers may comprise specific chemically synthesized oligonucleotides encoding restriction endonuclease recognition sequences. Finally, the vector may include a fusion polypeptide sequence such that the construct with the EV biosynthetic enzyme encodes a chimeric protein, such as a polyhistidine tag, FLAG tag, myc epitope tag, or some other such sequence for ease in purification.

Recombinant molecules can be introduced into host cells via transformation, transfection, infection, electroporation, etc., so that many copies of the gene sequence are generated. Preferably, the cloned gene is contained on a shuttle vector plasmid, which provides for expansion in a cloning cell, e.g., *E. coli*, and facile purification for subsequent insertion into an appropriate expression cell line, if such is desired.

Expression of EV Biosynthetic Enzyme Polypeptides

The nucleotide sequence coding for EV biosynthetic enzyme, or antigenic fragment, derivative or analog thereof, or a functionally active derivative, including a chimeric protein, thereof, can be inserted into an appropriate expression vector, i.e., a vector which contains the necessary elements for the transcription and translation of the inserted protein-coding sequence. Thus, a nucleic acid encoding EV biosynthetic enzyme of the invention can be operationally associated with a promoter in an expression vector of the invention. Such vectors can be used to express functional or functionally inactivated EV biosynthetic enzyme polypeptides.

The necessary transcriptional and translational signals can be provided on a recombinant expression vector.

Expression of EV biosynthetic enzyme protein may be controlled by any promoter/enhancer element known in the art, but these regulatory elements must be functional in the host selected for expression. Promoters which may be used to control EV biosynthetic enzyme gene expression include, but are not limited to, prokaryotic expression vectors such as the β-lactamase promoter (Villa-Komaroff, et al., Proc. Natl. Acad. Sci. U.S.A., 1978, 75:3727–3731), or the tac promoter (DeBoer, et al., Proc. Natl. Acad. Sci. U.S.A., 1983, 80:21–25; see also "Useful proteins from recombinant bacteria" in Scientific American, 242:74–94, 1980). Among regulable promoters which can be used in the context of the present invention, mention may be made more especially of any regulable promoter which is functional in actinomycetes. These can comprise promoters induced specifically by an agent introduced into to the culture medium, such as, for example, the thiostrepton-inducible promoter tipA (Murakami et al., J. Bact., 1989, 171:1459), or thermoinducible promoters such as that of the groEL genes, for example (Mazodier et al., J. Bact., 1991, 173:7382). They can also comprise an actinomycetes promoter which is specifically active in the late phases of the proliferation cycle of actinomycetes, such as, for example, certain promoters of genes of the secondary metabolism (genes for the production of antibiotics, in particular).

Soluble forms of the protein can be obtained by collecting culture fluid, or solubilizing inclusion bodies, e.g., by treatment with detergent, and if desired sonication or other mechanical processes, as described above. The solubilized or soluble protein can be isolated using various techniques, such as polyacrylamide gel electrophoresis (PAGE), isoelectric focusing, 2-dimensional gel electrophoresis, chromatography (e.g., ion exchange, affinity, immunoaffinity, and sizing column chromatography), centrifugation, differential solubility, immunoprecipitation, or by any other standard technique for the purification of proteins.

Antibodies to EV Biosynthetic Enzymes

According to the invention, any EV biosynthetic enzyme polypeptide produced recombinantly or by chemical synthesis, and fragments or other derivatives or analogs thereof, including fusion proteins, may be used as an immunogen to generate antibodies that recognize the EV biosynthetic enzyme polypeptide. Such antibodies include but are not limited to polyclonal, monoclonal, chimeric, single chain, Fab fragments, and an Fab expression library. The anti-EV biosynthetic enzyme antibodies of the invention may be cross reactive, e.g., they may recognize EV biosynthetic enzyme from different species. Polyclonal antibodies have greater likelihood of cross reactivity. Alternatively, an antibody of the invention may be specific for a single form of EV biosynthetic enzyme, such as murine EV biosynthetic enzyme. Preferably, such an antibody is specific for human EV biosynthetic enzyme.

Various procedures known in the art may be used for the production of polyclonal antibodies to EV biosynthetic enzyme polypeptide or derivative or analog thereof. For the production of antibody, various host animals can be immunized by injection with the EV biosynthetic enzyme polypeptide, or a derivative (e.g., fragment or fusion protein) thereof, including but not limited to rabbits, mice, rats, sheep, goats, etc. In one embodiment, the EV biosynthetic enzyme polypeptide or fragment thereof can be conjugated to an immunogenic carrier, e.g., bovine serum albumin (BSA) or keyhole limpet hemocyanin (KLH). Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (*bacille Calmette-Guerin*) and *Corynebacterium parvum*.

For preparation of monoclonal antibodies directed toward the EV biosynthetic enzyme polypeptide, or fragment, analog, or derivative thereof, any technique that provides for the production of antibody molecules by continuous cell lines in culture may be used. These include but are not limited to the hybridoma technique originally developed by Kohler and Milstein (Nature, 1975, 256:495–497), as well as the trioma technique, the human B-cell hybridoma technique (Kozbor et al., Immunology Today, 1983, 4:72; Cote et al., Proc. Natl. Acad. Sci. U.S.A., 1983, 80:2026–2030), and the EBV-hybridoma technique to produce human monoclonal antibodies (Cole et al., in Monoclonal Antibodies and Cancer Therapy, Alan R. Liss, Inc., 1985, pp. 77–96).

According to the invention, techniques described for the production of single chain antibodies (U.S. Pat. Nos. 5,476,786 and 5,132,405 to Huston; U.S. Pat. No. 4,946,778) can be adapted to produce EV biosynthetic enzyme polypeptide-specific single chain antibodies. Indeed, these genes can be delivered for expression in vivo. An additional embodiment of the invention utilizes the techniques described for the construction of Fab expression libraries (Huse et al., Science, 1989, 246:1275–1281) to allow rapid and easy identification of monoclonal Fab fragments with the desired specificity for an EV biosynthetic enzyme polypeptide, or its derivatives, or analogs.

Antibody fragments which contain the idiotype of the antibody molecule can be generated by known techniques. For example, such fragments include but are not limited to: the $F(ab')_2$ fragment which can be produced by pepsin digestion of the antibody molecule; the Fab' fragments which can be generated by reducing the disulfide bridges of the $F(ab')_2$ fragment, and the Fab fragments which can be generated by treating the antibody molecule with papain and a reducing agent.

In the production of antibodies, screening for the desired antibody can be accomplished by techniques known in the art, e.g., radioimmunoassay, ELISA (enzyme-linked immunosorbant assay), "sandwich" immunoassays, immunoradiometric assays, gel diffusion precipitin reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention. For example, to select antibodies which recognize a specific epitope of an EV biosynthetic enzyme polypeptide, one may assay generated hybridomas for a product which binds to an EV biosynthetic enzyme polypeptide fragment containing such epitope. For selection of an antibody specific to an EV biosynthetic enzyme polypeptide from a particular species of animal, one can select on the basis of positive binding with EV biosynthetic enzyme polypeptide expressed by or isolated from cells of that species of animal.

The foregoing antibodies can be used in methods known in the art relating to the localization and activity of the EV biosynthetic enzyme polypeptide, e.g., for Western blotting, imaging EV biosynthetic enzyme polypeptide in situ, measuring levels thereof in appropriate physiological samples, etc. using any of the detection techniques mentioned above or known in the art.

In a specific embodiment, antibodies that agonize or antagonize the activity of EV biosynthetic enzyme polypeptide can be generated. Such antibodies can be tested using the assays described infra for identifying ligands.

Techniques of isolating bacterial DNA are readily available and well known in the art. Any such techniques can be employed in this invention. In particular DNA from these deposited cultures can be isolated as follows. Lyophils of *E. coli* XL1-Blue/pSPRX272, *E. coli* XL1-Blue/pSPRX2262, *E. coli* XL1-Blue/pSPR192 *E. coli* XL1-Blue/pSPRX210 or *E. coli* XL1-Blue/pSPRX256 are plated onto L-agar (10 g tryptone, 10 g NaCl, 5 g yeast extract, and 15 g agar per liter) plates containing 100 µl/ml ampicillin to obtain a single colony isolate of the strain. This colony is used to inoculate about 500 ml of L-broth (10 g tryptone, 10 g NaCl, 5 g yeast extract per liter) containing 100 µg/ml apramycin, and the resulting culture is incubated at 37° C. with aeration until the cells reach stationary phase. Cosmid DNA can be obtained from the cells in accordance with procedures known in the art (see, e.g., Rao et al., Methods in Enzymology, 1987, 153:166).

DNA of the current invention can be sequenced using any known techniques in the art such as the dideoxynucleotide chain-termination method (Sanger et al., Proc. Natl. Acad. Sci., 1977, 74:5463) with either radioisotopic or fluorescent labels. Double-stranded, supercoiled DNA can be used directly for templates in sequence reactions with sequence-specific oligonucleotide primers. Alternatively, fragments can be used to prepare libraries of either random, overlapping sequences in the bacteriophage M13 or nested, overlapping deletions in a plasmid vector. Individual recombinant DNA subclones are then sequenced with vector-specific oligonucleotide primers. Radioactive reaction products are electrophoresed on denaturing polyacrylamide gels and analyzed by autoradiography.

Fluorescently labeled reaction products are electrophoresed and analyzed on Applied Biosystems (ABI Division, Perkin Elmer, Foster City, Calif. 94404) model 370A and 373A or Dupont (Wilmington, Del.) Genesis DNA sequencers. Sequence data are assembled and edited using Genetic Center Group (GCG, Madison, Wis.) programs GelAssemble and Seqed or the ABI model 670 Inherit Sequence Analysis system and the AutoAssembler and SeqEd programs.

Polypeptides corresponding to a domain, a submodule, a module, a synthesis unit (SU), or an open reading frame can be produced by transforming a host cell such as bacteria, yeast, or eukaryotic cell-expression system with the cDNA sequence in a recombinant DNA vector. It is well within one skilled in the art to choose among host cells and numerous recombinant DNA expression vectors to practice the instant invention. Multifunctional polypeptides of polyketide everninomicin synthase can be extracted from everninomicin-producing bacteria such as Streptomyces ambofaciens or translated in a cell-free in vitro translation system. In addition, the techniques of synthetic chemistry can be employed to synthesize some of the polypeptides mentioned above.

Procedures and techniques for isolation and purification of proteins produced in recombinant host cells are known in the art. See, for example, Roberts et al., Eur. J. Biochem., 1993, 214: 305–311 and Caffrey et al., FEBS, 1992, 304:225–228 for detailed description of polyketide synthase purification in bacteria. To achieve a homogeneous preparation of a polypeptide, proteins in the crude cell extract can be separated by size and/or charge through different columns well known in the art once or several times. In particular the crude cell extract can be applied to various cellulose col umns commercially available such as DEAE-cellulose columns. Subsequently the bound proteins can be eluted and the fractions can be tested for the presence of the polyketide everninomicin synthase or engineered derivative protein. Techniques for detecting the target protein are readily available in the art. Any such techniques can be employed for this invention.

In particular the fractions can be analyzed on Western blot using antibodies raised against a portion or portions of such polyketide everninomicin synthase proteins. The fractions containing the polyketide everninomicin synthase protein can be pooled and further purified by passing through more columns well known in the art such as applying the pooled fractions to a gel filtration column. When visualized on SDS-PAGE gels homogeneous preparations contain a single band and are substantially free of other proteins.

Actinomycetes are prolific producers of secondary metabolites with antimicrobial and antifungal activity and represent a significant source of active compounds for pharmaceuticals. The genus Streptomyces produces a wide variety of secondary metabolites including antitumor, antifungal, and antimicrobial agents. The biosynthesis of these compounds has been shown to be directed by large multi-functional proteins or a number of proteins each catalyzing specific steps in the biosynthesis of the secondary metabolite (REF-Biotechnology of AB etc.) The genes encoding actinomycete secondary metabolite biosynthesis have been found to be clustered on contiguous segments of each producing organisms genome (Strohl, William R., 1997, Biotechnology of Antibiotics, $2^{nd}$ Ed., Marcel Dekker, Inc., New York, N.Y.). This makes it feasible for complete pathways to be cloned, analyzed, genetically manipulated and expressed in surrogate hosts.

Components of the Everninomicin Biosynthethic Pathway Orselliic Acid Biosynthesis The term "polyketide" refers to a class of molecules produced through the successive condensation of small carboxylic acids. This diverse group includes plant flavonoids, fungal aflatoxins, and hundreds of compounds of different structures that exhibit antibacterial, antifungal, antitumor, and anthelmintic properties. Some polyketides produced by fungi and bacteria are associated with sporulation or other developmental pathways; others do not yet have an ascribed function. Some polyketides have more than one pharmacological effect. The diversity of polyketide structures reflects the wide variety of their biological properties. Many cyclized polyketides undergo glycosidation at one or more sites, and virtually all are modified during their synthesis through hydroxylation, reduction, epoxidation, etc.

For the purposes of the present invention, "polyketide" refers to the orsellenic acid moiety in everninomicin. Thus, the invention provides, in particular, the DNA sequence encoding the polyketide synthase responsible for biosynthesis of this orsellinic acid moiety of everninomicin, i.e., the everninomicin orsellinic acid synthetase. The everninomicin orsellinic acid synthase DNA sequence, which defines the orsellinic synthase gene cluster, directs biosynthesis of the orsellinic acid polyketide by encoding the various distinct activities of orsellinic synthase. The skilled artisan recognizes, however, that the everninomicin orsellinic synthase genes are useful in the production of other polyketides, e.g., by recapitulating all or part of this component of the biosynthetic pathway, or by modulating biosynthetic pathways (see, the discussion about combinatorial biosynthesis, infra).

Figure 4A:
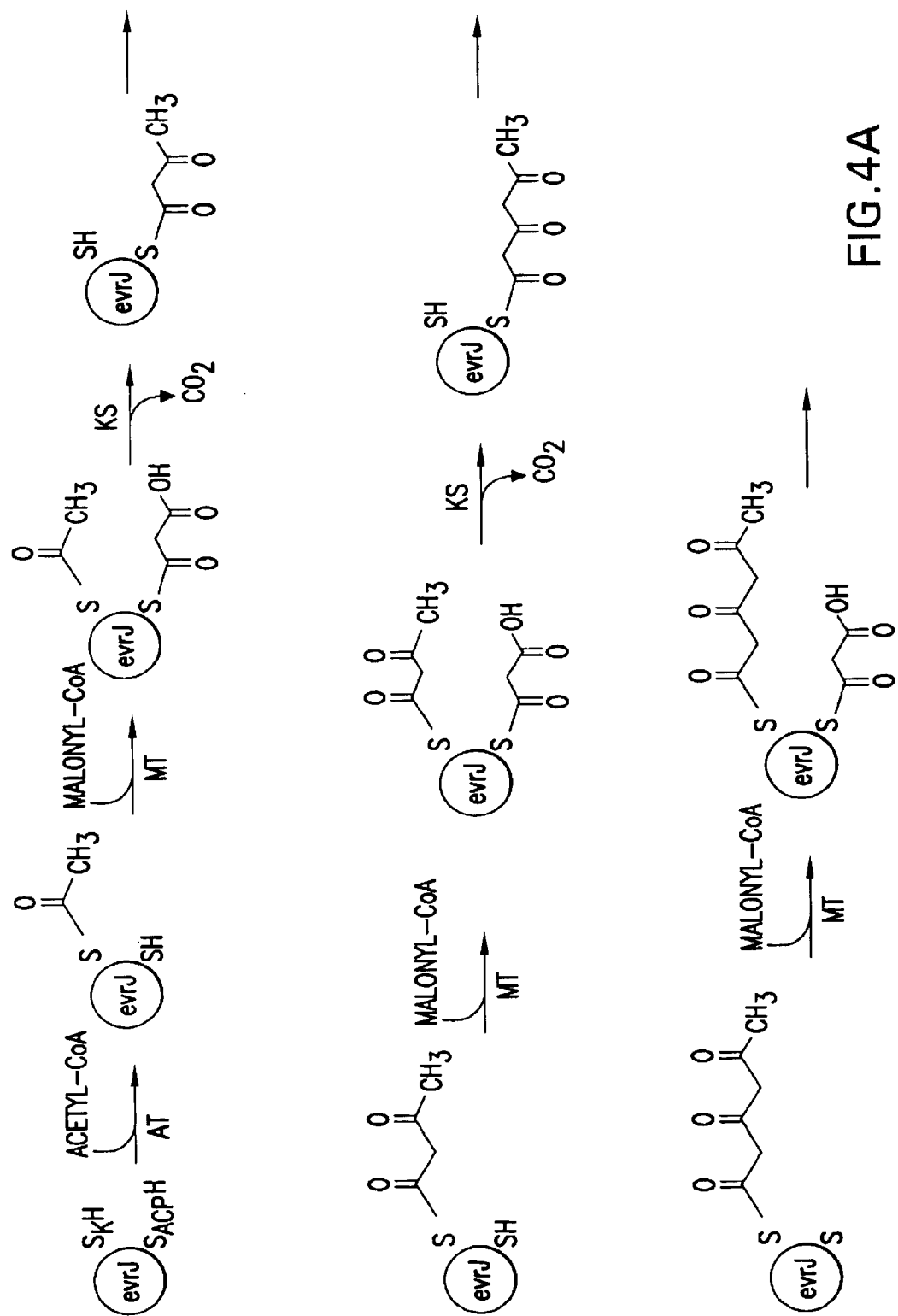
FIGS. 4A–B. Proposed biosynthetic pathway for orsellinic acid synthesis by evrJ and malonylCo-A synthesis by evbD. (A) Orsellinic acid biosynthesis. (B) Malonyl-CoA biosynthesis.
Figure 4B:
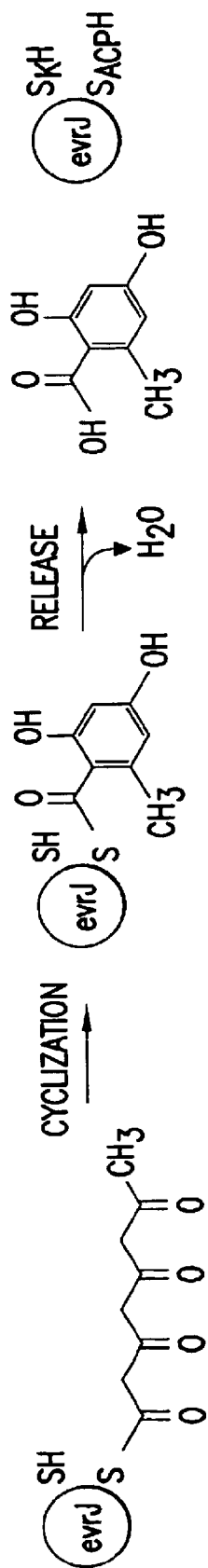
Figure 5:
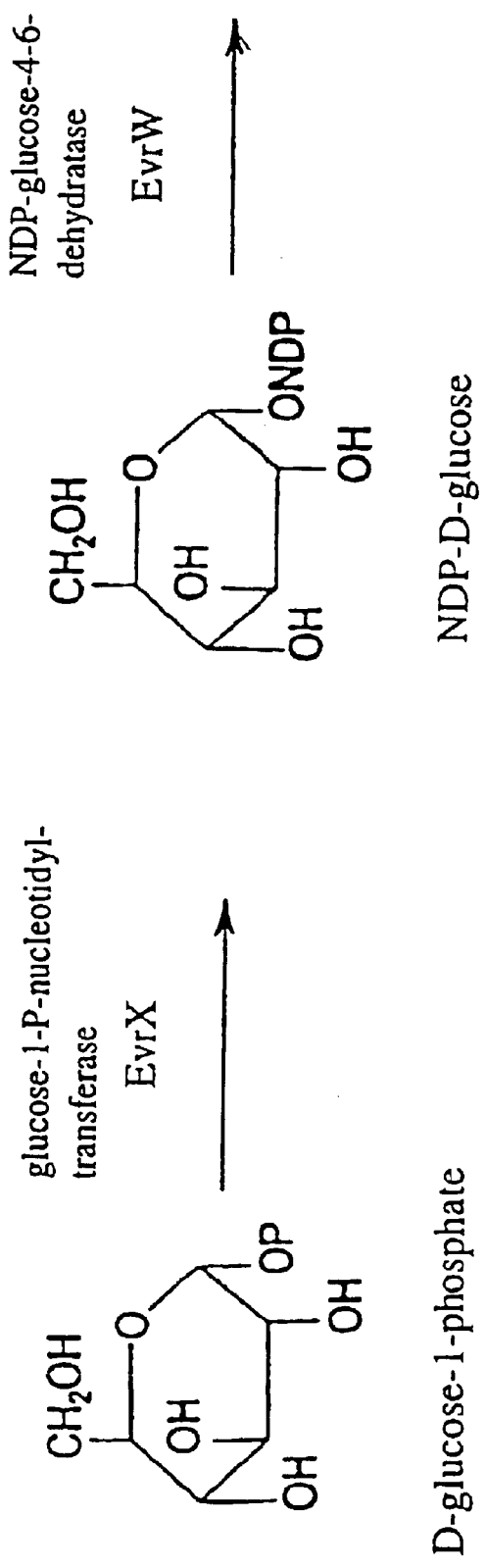
FIGS. 5A–B. Biosynthetic pathway for D-6-deoxysugar and L-6-deoxysugar biosynthesis by evrV evrW, and evrX.
Figure 5:
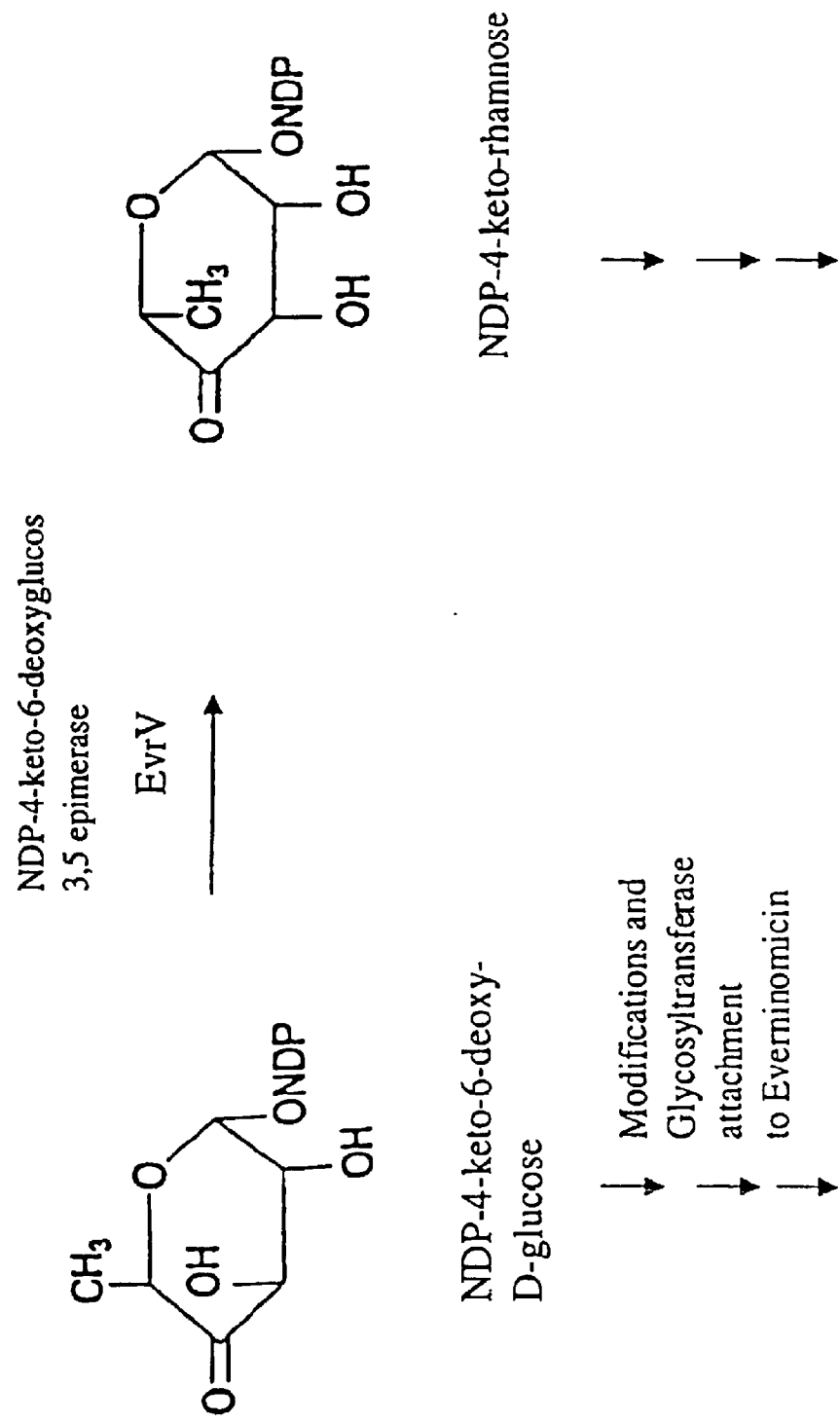

The gene cluster for orsellinic synthase, like other Type I polyketide biosynthetic synthase genes whose organization has been elucidated, is characterized by the presence of an ORF encoding a multi-functional protein which contains separate, active sites for condensation of acyl groups as defined above. The map of the orsellinic synthase gene derived from *Micromonospora carbonacea* var. *africana* is shown in FIG. 3. The accompanying synthetic pathway and the specific carboxylic acid substrates that are used for each condensation of orsellinic acid synthesis are indicated in FIG. 4.

Polyketides are complex secondary metabolites synthesized from the condensation of acetyl-coenzyme A (CoA) or related acyl-CoAs by polyketide synthetase enzymes. Other acyl groups forming the acyl-CoA include malonyl, proponyl, and butyryl. Condensation of extender units requires the action of β-ketoacyl ACP synthetase, acetyltransferase and acyl carrier protein enzymatic sites. Each module processes one condensation step and typically requires several activities accomplished by several active sites including acyl carrier protein (ACP), β-ketosynthase (KS), and acyltransferase (AT). The specific gene products identified with orsellinic biosynthesis are listed in Table 2.

TABLE 2

Orsellinic Acid Biosynthetic Gene Products

| Gene Product | CDS | SEQ ID No. | Enzymatic Function |
|---|---|---|---|
| evrF | 21,064 ... 22,542 | 36, 37 | non-heme oxygenase/halogenase addition |
| evrI | 25,550 ... 26,626 | 42, 43 | acyl starter unit |
| evrJ | 26,685 ... 30,479 | 44, 45 | Orsellinic acid synthase/6-methylsalicilic acid synthase |
| evbD | 56,961 ... 58,709 | 92, 93 | acyl-CoA carboxylase |
| evbQ | 74,707 ... 76,290* | 122, 123 | Methylmalonyl-CoA mutase |

Polyketide synthetase are classified as either iterative Type I, iterative Type II or modular polyketide sythetases. Iterative Type I synthetases resemble the multifunctional fatty acid synthases from animals and are composed of multifunctional proteins with separate protein domains encoding each active sites. This is exemplified by the actinomycete *S. erythrea* polyketide synthetase for the biosynthesis of erythromycin, the *Streptomyces viridochromogenes* Tu57 AviM synthesis of orsellinic acid and the *Penicillium patulum* polyketide synthase for 6-methylsalicylic acid (Hutchinson et al., Annual Review of Microbiology, 1995, 49:201–238; Gaisser et al., Journal of Bacteriology, 1997, 179:6271–6278; Beck et al., European Journal of Biochemistry, 1990, 192:487–498). Iterative type II synthetases have seperate proteins for each active site. These are exemplified by the polyketide synthetases from *S. coelicolor, S. violaceoruber* and *S. glaucescens* synthesizing the aromatic polyketides actinorhodin, granaticin and tetracenomycin respectively (Hopwood, et al., Annual Review of Microbiology 1990, 24:37–66). The modular polyketide synthetases are large proteins that contain several domains with each domain containing several active sites. An example of a modular polyketide synthetase is the 6-deoxyerythronolide B synthetase from *Saccharopolyspora erythraea*. Recent reviews of polyketides and polyketide synthetases elaborate on these pathways (Hopwood, et al., Annual Review of Microbiology, 1990, 24:37–66; Hutchinson et al., Annual Review of Microbiology, 1995, 49:201–238).

Although not wishing to be bound to any particular theory or technical explanation, a sequence similarity exists among domain boundaries in various polyketide synthase genes. Thus, one skilled in the art is able to predict the domain boundaries of newly discovered polyketide synthase genes based on the sequence information of known polyketide synthase genes. In particular, the boundaries of submodules, domains, and open reading frames in the instant application are predicted based on sequence information disclosed in this application and the locations of the domain boundaries of the everninomicin synthase (Donadio et al., GENE, 1992, 111:51–60). Furthermore, the genetic organization of the everninomicin synthase gene cluster appears to correspond to the order of the reactions required to complete synthesis of everninomicin. This means that the polyketide synthase DNA sequence can be manipulated to generate predictable alterations in the final everninomicin product.

Acyl Precursor Formation

EvrJ (orsellinic acid synthetase) requires one acetyl-CoA starter and three malonyl-CoA extender units to synthesize orsellinic acid. The acetyl-CoA and malonyl-CoA units most likely are derived from glycolysis and fatty acid biosynthesis (Tang L, et al., Ann. N Y Acad. Sci., 1994, 721:105–16). The malonyl-CoA can also be derived from acetyl-CoA by carboxylation by acetylCoA carboxylase, (Scott Eagleson, Concise Encyclopedia of Biochemistry, $2^{nd}$ Ed., Walter de Gruyler; Berlin, 1988). The *M. carbonacea* EV region contains an evbD which has strong homology to know acetyl-CoA carboxylases. Thus evbD is responsible for the synthesis of the malonyl-CoA unit required for orsellinic acid biosynthesisas shown in FIG. 4.

Sugar Biosynthetic Products and Glycosyltransferases

Glycosyl groups (6-deoxysugars) are synthesized by a common mechanism involving hexose-1-P nucleotidyltransferase, dTDP-D-glucose synthetase and dTDP-D-glucose 4,6-dehydratase. L-deoxysugars are synthesized by the action of a NDP-4-keto-6-deoxyhexose 3,5-epimerase. Deoxysugars can be modified by deoxygenations, transaminations, methylations and isomerization or epimerizations prior to covalent attachment by a glycosyltransferase.

Biosynthesis of the sugars (see Liu and Thorson, Annu. Rev. Microbiol., 1994, 48:223) that are attached to the orsellinic acid/polyketide, and the enzymes that mediate attachment of the sugars, are also key elements of the everninomicin biosynthetic pathway. Genes encoding such sugar biosynthetic enzymes and glycosyltransferases are typically found in the biosynthetic pathway locus (see Summers et al., Microbiology, 1997, 143:3251). The genes identified from the EV biosynthetic locus are listed in Tables 3 and 4.

TABLE 3

Sugar Biosynthetic Gene Products

| Gene Product | CDS | SEQ ID No. | Enzymatic Function |
|---|---|---|---|
| evdA | 132 ... 1382* | 2, 3 | hydroxylase |
| evdB | 1490 ... 2611* | 4, 5 | hexose aminotransferase |
| evdC | 2622 ... 3860* | 6, 7 | oxidase (flavoprotein) |
| evdE | 5309 ... 6235 | 8, 9 | hexose dehydratase |
| evdI | 9463 ... 10,224* | 18, 19 | Hydrolase |

TABLE 3-continued

Sugar Biosynthetic Gene Products

| Gene Product | CDS | SEQ ID No. | Enzymatic Function |
|---|---|---|---|
| evdK | 11,208 . . . 12,455 | 22, 23 | hexose dehydratase or epimerase |
| evrA | 14,410 . . . 15,363* | 26, 27 | hexose epimerase |
| evrB | 15,380 . . . 16,414* | 28, 29 | hexose oxidoreductase |
| evrC | 16,419 . . . 17,873* | 30, 31 | hexose dehydratase |
| evrD | 17,870 . . . 18,934* | 32, 33 | GDP-mannose 4,6-dehydratase |
| evrV | 41,679 . . . 42,707* | 68, 69 | dTDP-glucose epimerase |
| evrW | 42,810 . . . 43,799* | 70, 71 | dTDP-glucose dehydratase |
| evrX | 43,799 . . . 44,866 | 72, 73 | dTDP-glucose synthetase |
| evbS | 78,791 . . . 80,521 | 126, 127 | Phosphomannomutase |
| evbU | 83,280 . . . 83,888 | 130, 131 | Glucose-6-phosphate 1-dehydrogenase |
| ORF9 | 8254 . . . 9318 | 199, 200 | Oxidoreductase |
| ORF11 | 10,584 . . . 11,585 | 203, 204 | Deoxyhexose ketoreductase |

TABLE 4

Glycosyltransferases

| Gene Product | CDS | SEQ ID No. | Enzymatic Function |
|---|---|---|---|
| evdD | 4143 . . . 5312 | 8, 9 | DNTP-hexose glycosyltransferase |
| evdF | 6232 . . . 7275 | 12, 13 | DNTP-hexose glycosyltransferase |
| evdH | 8342 . . . 9364 | 16, 17 | DNTP-hexose glycosyltransferase |
| evdL | 12,108 . . . 13,022* | 24, 25 | DNTP-hexose glycosyltransferase |
| evrS | 38,892 . . . 40,163* | 62, 63 | DNTP-hexose glycosyltransferase |

These genes are important targets for modulation. They are likely to be bottleneck genes, and thus increased expression using an exogenous or integrating vector can increase the yield of everninomicin (or its analog). Alternatively, knocking out these genes may result in complete elimination of everninomicin biosynthesis.

Tailoring Enzymes

Various types of EV biosynthetic enzymes fall into the tailoring enyzme category. These are listed in Table 5. Increasing or decreasing expression of these enzymes permits production of everninomicin analogs. Moreover, expression of these enzymes in other actinomycetes permits production of novel secondary metabolites by the action of the everninomicin tailoring enzymes on these metabolites.

TABLE 5

Tailoring Gene Products

| Gene Product | CDS | SEQ ID No. | Enzymatic Function |
|---|---|---|---|
| evrG | 22,748 . . . 24,172 | 38, 39 | oxidase |
| evrL | 31,941 . . . 32,882* | 48, 49 | heme biosynthesis |
| evrM | 33,167 . . . 34,405* | 50, 51 | p450 hydroxylase |
| evrN | 34,449 . . . 35,210* | 52, 53 | methyl transferase |

TABLE 5-continued

Tailoring Gene Products

| Gene Product | CDS | SEQ ID No. | Enzymatic Function |
|---|---|---|---|
| evrQ | 36,998 . . . 38,026* | 58, 59 | oxidoreductase/heat stress protein |
| evrT | 40,216 . . . 40,890 | 64, 65 | L-proline hydroxylase |
| evrU | 40,887 . . . 41,576 | 66, 67 | methyltransferase |
| evbA | 53,554 . . . 54,207 | 84, 85 | o-methyltransferase |
| evbE | 58,873 . . . 60,312 | 94, 95 | IMP dehydrogenase |
| evbI | 66,469 . . . 67,872* | 106, 107 | lipoamide dehydrogenase |
| evbL | 69,610 . . . 70,359* | 112, 113 | acetyltransferase/phosphotransferase |
| evbX | 85,909 . . . 87,342 | 136, 137 | aldehyde dehydrogenase |
| exbY | 87,422 . . . 88159 | 138, 139 | aldehyde dehydrogenase |
| evcB | 89,817 . . . 91,067 | 144, 145 | cytochrome D oxidase subunit I |
| evcC | 91,078 . . . 92,085 | 146, 147 | cytochrome D oxidase subunit II |

Regulatory Products: Serine-Threonine Kinases

Protein serine (Ser), threonine (Thr), and tyrosine (Tyr) kinases play essential roles in signal transduction in organisms ranging from yeast to mammals, where they regulate a diverse cellular activities. Genes that encode eukaryotic-type protein kinases have also been identified in different bacterial species, suggesting that such enzymes are also widespread in prokaryotes. Although many of them have yet to be fully characterized, several studies indicate that eukaryotic-type protein kinases play important roles in regulating cellular activities of these bacteria, such as cell differentiation and secondary metabolism (Cheng-Cai, Molecular Microbiology, 1996, 20:9–15). Examples that have been studied include the pknD Ser/Thr kinase from *Anabaena sp.* PCC7120, which is involved in nitrogen metabolism control (Zhang et al., Molecular and General Genetics, 1998, 258:26–33); the pkn9 Ser/Thr kinase from *Myxococcus xanthus*, which is involved in development of fruiting bodies (Hanlon et al., Molecular Microbiology, 1997, 23:459–71); and the afsK Ser/Thr kinase from *Streptomyces coelicolor*, which is involved in aerial myceliaum formation (Ueda et al., Gene, 1996, 169:91–95). These genes from the EV biosynthetic locus are listed in Table 6.

TABLE 6

Regulatory Gene Products

| Gene Product | CDS | SEQ ID No. | Enzymatic Function |
|---|---|---|---|
| evrR | 38,072 . . . 38,566 | 60, 61 | hexaheme nitrite reductase regulator/methyltransferase |
| evsA | 47,156 . . . 49,234* | 78, 79 | serine-threonine kinase |
| evbF | 60,472 . . . 61,029* | 96, 97 | |
| evbF2 | 61,610 . . . 62,069 | 100, 101 | |
| evbK | 68,529 . . . 69,494* | 110, 111 | protease synthase/sporulation regulator |
| evbR | 76,622 . . . 78,712 | 124, 125 | protein serine-threonine kinase (eukaryotic type) |
| evcJ | 100,733 . . . 101,326* | 160, 161 | ATP/GTP binding protein |
| ORF1 | 189 . . . 1064* | 183, 184 | Transcriptional regulator biotinylation |
| ORF4 | 3776 . . . 4276* | 189, 190 | ECF sigma factor |

The evsA and evbR proteins within the everninomicin cluster have a high degree of homology to Ser/Thr kinases and may play a role in regulating the expression of the pathway. Manipulation of the evsA and evbR proteins could enhance the expression and yield of everninomicin from *M. carbonacea* by providing positive signals for biosynthesis. Thus, these genes are preferred elements in a vector to enhance the efficiency of everninomicin biosynthesis.

Resistance Mechanisms

Actinomycetes utilize a variety or mechanisms to confer resistance to secondary metabolites they produce. These include membrane pumps, rRNA methylases, O-phosphorylation, N-acetylation, and production of resistant target proteins (Cundliffe, Annual Review of Microbiology, 1989, 43:207–33). The genes from the EV biosynthetic locus that have this function are listed in Table 7.

TABLE 7

Resistance Mechanism Genes

| Gene Product | CDS | SEQ ID No. | Enzymatic Function |
|---|---|---|---|
| evrE | 19,374 . . . 20,906 | 34, 35 | multidrug efflux transporter |
| evrY | 45,014 . . . 45,760* | 74, 75 | dehalogenase |
| evrZ | 45,962 . . . 46,714* | 76, 77 | muramidase/ lysozyme |
| evbB | 54,362 . . . 55,117* | 86, 87 | membrane pump |
| evbC | 55,135 . . . 56,094* | 88, 89 | membrane pump |
| evbC2 | 56,184 . . . 56,813* | 90, 91 | ankrylin-like |
| evbG | 62,122 . . . 63,795 | 102, 103 | ABC transporter |
| evbH | 63,891 . . . 65,828 | 104, 105 | ABC transporter |
| evcD | 92,148 . . . 93,833 | 148, 149 | ABC transporter |
| evcE | 93,830 . . . 95,671 | 150, 151 | ABC transporter |
| evrMR | 107,653 . . . 108,615 | 172, 173 | 23S rRNA methylase |
| evrMR12 | 108,635 . . . 109,216 | 174, 175 | |
| ORF6 | 5392 . . . 6147* | 193, 194 | rRNA methyltransferase |

Multi-drug transporters are membrane proteins that are able to expel a broad range of toxic molecules from the microbial cells. These multidrug transporters belong to the ATP-binding cassette (ABC) family of transport proteins that utilize the energy of ATP hydrolysis for activity. In microorganisms, multidrug transporters play an important role in conferring antibiotic resistance on pathogens, and in actinomycetes confer resistance to the antibiotic secondary metabolites produced by these organisms themselves (Fath et al., Microbial Reviews, 1993, 57:995–1017). A second class of membrane transporters that are found in actinomycetes include MDR (multiple drug resistance) type pumps found in eukaryotes (Guilfoile et al., Proc. Natl. Acad. Sci. USA, 1991, 88:8553–8557). The EV cluster contains evbB and evbC, which are homologouse to the ATP-binding cassette (ABC) family of transport proteins and specifically to the mithramycin resistance pump from *Streptomyces argillaceus* (Fernandez et al., Molecular and General Genetics, 1996, 251:692–698). In addition the EV cluster contains evrE, an MDR type pump with homology to the *Streptomyces peucetius* drrA MDR type pump that confers resistance to daunorubicin. Ribosomal methylases have also been found to confer resistance to producing organisms. The tlrB 23S rRNA methylase from *Streptomyces fradiae* and the myrA 23S rRNA methylase from *Micromonospora griseorubida* have been found to confer resistance to tylosin and mycinamicin respectively.

The EV cluster also contains evrMR, a 23 RNA methylase with (loc.) homology to both tlrB and myrA.

The EV pathway also contains evrZ, a gene with homology to muramidases. Muramidases (lysozyme) cleave β1,4 linkages between N-acetylglucosamine and N-acetylmuramic acid (Scott and Eagleson, Concise Encyclopedia Biochemistry, $2^{nd}$ Ed., Walter de Gruyter: Berlin, 1988 p. 353). Thus, evrZ may inactivate everninomicin by cleavage within the glycosyl bonds.

Increased levels of expression of one or more of these resistance genes is expected to enhance the efficiency of everninomicin biosynthesis in an enhanced biosynthetic system by reducing toxicity to the host cell.

Furthermore, these resistance genes are good candidates for use as positive selection markers in recombinant systems. By including an everninomicin resistance gene in a vector, a host cell successfully transformed with the vector will demonstrate everninomicin resistance. Thus, everninomicin becomes a useful tool for selecting transformed host cells.

Biosynthetic Production and Modification of Everninomicins

There are a number of uses for the cloned *Micromonospora carboonacea* EV cluster DNA. The cloned genes can be used to improve the yields of everninomicins and to produce novel everninomicins. Improved yields can be obtained by introduction of a second copies of genes for enzymes that are rate limiting in the pathway ("bottleneck genes"). This can be accomplished by cloning genes onto vectors, preferably integrating vectors, then obtaining integrants in the chromosome. Alternatively, a rate limiting enzyme gene can be modified by associating it with a strongly expressing promoter sequence and then integrating this construct into the chromosome. Manipulation of regulatory proteins including the Ser/Thr kinases can enhance yields by obtaining mutants that express EV pathway genes at higher levels than parental organisms.

Novel everninomicins can be produced by using cloned fragments to disrupt steps in the biosynthesis of everninomicin. Disruptions can lead to the accumulation of precursors or "shunt" products. To generate disruptions, DNA fragments of internal segments of genes (lacking 5' and 3' sequences) can be cloned into insertion vectors. These constructs can be introduced into the parental organism and homologous recombinants selected for that result in two copies of the gene in the chromosome. One copy lacks 3' sequences and the second copy lacks upstream native promoter sequences and 5' sequences. Alternatively, DNA fragments of genes containing internal deletions or insertions can be cloned into gene replacement vectors. Recombinants can be obtained that contain internal deletions or insertions of genes, which results in a non-functional chromosome copy of the gene. Constructs that allow a frequency of recombination into the chromosome to obtain disruptions should contain fragments of sufficient size for recombination to occur (300 to 600 bases). Modified everninomicins produced by disrupting the genes may be antibiotics themselves, or serve as substrates for further chemical modification, creating new semi-synthetic everninomicins with unique properties or spectra of activity.

Novel everninomicins can also be produced by mutagenesis of the cloned genes, and replacement of the mutated genes for their unmutated counterparts in the everninomicin producer. Mutagenesis may involve, for example, (1) manipulation of the orsellinic acid PKS TypeI gene by introduction of KR, DH or ER domains (see, Donidio et al., 1993), e.g., to yield a modified orsellenic acid nucleus; (2)

manipulation of the glycosyltranferase to relax substrate or glycosyl specificity, e.g., to yield everninomicin containing novel glycosyl groups or additional glycosyl groups; and/or (3) manipulation of glycosyl biosynthetic genes, e.g., to yield novel glycosyl groups and everninomicin containing novel glycosyl groups.

The DNA from the everninomicin biosynthetic cluster can be used as a hybridization probe to identify homologous sequences. Thus, the DNA cloned here could be used to obtain uncloned regions flanking the region described here but not yet isolated. In addition DNA from the region cloned here may be useful in identification of non-identical but similar sequences in other organisms.

The modified strains provided by the invention may be cultivated to provide everninomicins using conventional protocols.

Genetic Manipulation of a Actinomycetes

Protocols have been developed to genetically manipulate actinomycete genomes and biosynthetic pathways. These include *E. coli* actinomycete shuttle vectors, gene replacement systems, transformation protocols, transposon mutagenesis, insertional mutagenesis, integration systems and heterologous host expression. These techniques are reviewed in numerous articles (Baltz et al, Trends Microbiol., 1998, 2:76–83, Hopwood et al., Genetic Manipulation of Streptomyces: A Laboratory Manual, 1985; Wohlleben et al., Acta Microbiol. Immunol. Hung, 1994, 41:381–9 [Review]).

The development of vectors for the genetic manipulation of actinomycetes began with the observation of plasmids in actinomycetes and the development of a transformation protocol of actinomycete protoplasts using polyethylene glycol (Bibb et al., Nature, 1980, 284:526–31). Many standard molecular techniques for *Streptomyces* were developed by Hopwood and colleages for *Streptomyces coelicolor* and *Streptomyces lividans* (Hopwood et al., Genetic Manipulation of Streptomyces: A Laboratory Manual, 1985). These techniques have been adapted and expanded to other actinomycetes.

Vectors incorporating antibiotic-resistance markers (AmR, ThR, SpR) that function in *Streptomyces spp.* and other features have allowed the development of vectors for (a) integration via homologous recombination between cloned DNA and the *Streptomyces spp.* chromosome, (b) autonomous replication, and (c) site-specific integration at the bacteriophage phiC31 attachment (att) site or pSAM2 attachment site, and (d) gene replacement vectors. Homologous recombination between the cloned DNA and the chromosome can be used to make insertional knockouts of specific genes. Autonomously replicating plasmids and integrating plasmids can be used to introduce heterologous genes into actinomycetes for complementation or expression studies.

Many actinomycetes contain restriction systems that limit the ability to transform organisms by protoplast transformation. More recent gene transfer procedures have been developed for introducing DNA into streptomycetes by conjugation from *Escherichia coli*. This employs a simple mating procedure for the conjugal transfer of vectors from *E. coli* to *Streptomyces spp.* that involves plating of the donor strain and either germinated spores or mycelial fragments of the recipient strain. Conjugal plasmids contain the 760-bp oriT fragment from the IncP plasmid, RK2 and are transferred by supplying transfer functions in trans by the *E. coli* donor strain. Other recent developments that increase the frequency of recombination of non-replicating plasmids into the recipient actinomycete chromosome include transformation of non-replicating plasmids into protoplasts using denatured plasmid DNA (Oh and Chater, J. Bacteriol., 1997, 179:122–7) and conjugation of non-replicating plasmids from a methyl minus strain of *E. coli*. (Smith et al., FEMS Microbiol. Lett., 1997, 155:223–9).

Various strategies have been used to obtain gene replacements in streptomycetes, for the construction of mutations and the modification of biosynthetic pathways (Baltz et al., 1998, supra; Hopwood et al., supra; Wohllenben et al., 1994, supra; Baltz and Hosted, TIBTECH, 1996, 14:245; Baltz, Curr. Op. Biotech., 1990, 1:12–20). These methods have typically employed a two or three step procedure that results in allelic exchange. Initial crossover events between a non-intergrating phage, non-replicating plasmid, or temperature sensitive plasmid and the streptomycete chromosome are selected for by antibiotic resistance. Subsequent recombination events that result in gene replacement can be detected by screening the progeny of the initial recombinants by PCR analysis, Southern analysis, appearance of an expected phenotype or screening for the loss of a resistance marker which had previously been exchanged into the loci to be replaced. The last of these methods has been employed by Khosla et al., Mol. Microbiol., 1992, 6:3237–49; Khosla et al., J. Bacteriol., 1993, 175:2197–204, to successfully modify the polyketide biosynthetic route of *S. coelicolor*. The strategy employed by Khosla et al., 1992, supra, also has the advantage of allowing placement of non-selectable and phenotypically silent alleles into chosen positions of the chromosome. Donadio et al., Proc. Natl. Acad. Sci. U.S.A., 1993, 90:7119–23 has also successfully reprogrammed the erythromycin pathway of *Saccharopolyspora erythrae* by gene replacement.

Non-replicating plasmids for gene replacement were initialy utilized by Hilleman et al., Nucleic Acids Res., 1991, 19:727–31, who used a derivative of pDH5 to construct mutations in the phosphinothricin tripeptide biosynthetic pathway of *S. hygroscopicus*. Plasmid-integration events were obtained by thiostrepton selection, subsequent screening of the primary recombinants indicated that 4 of 100 isolates had undergone a double-crossover gene replacement.

Use of counterselectable or negative selection markers such as rpsL (confers streptomycin sensitivity) or sacB (confers sucrose sensitivity) have been widely employed in other microorganisms for selection of recombination that results in gene replacement. In *S. coelicolor*, Buttner utilized glk as a counterselectable marker in att minus phiC31 phage to select for recombination events to construct gene replacement mutants of three *S. coelicolor* RNA polymerase sigma factors (Buttner et al., J. Bacteriol., 1990, 172:3367–78). Hosted has developed a gene replacement system utilizing the rpsL gene for counterselection (Hosted and Baltz, J. Bacteirol., 1997, 179:180–6).

The construction of recombinant streptomycete strains to produce hybrid secondary metabolites has been accomplished. Current procedures use recombinant DNA techniques to isolate and manipulate secondary metabolic pathways and to express these pathways in surrogate hosts such as *Streptomyces lividans*. Heterologous expression of diverse pathways, polyketide, oligopeptide and β-lactam biosynthetic pathways, has been achieved. Furthermore novel polyketide structures have been generated through the manipulation of polyketide genes forming chimeric pathways. Recently novel polyketide modules have been isolated from environmental sources using PCR amplification and expressed in Streptomyces to yield novel chemical structures (Strohl et al., J. Industr. Microbiol., 1991, 7:163; Kim et al., J. Bacteriol., 1995, 77:1202; Ylihonko et al., Microbiology, 1996, 142:1965).

Knowledge of the everninomicin synthase DNA sequence, its genetic organization, and the activities associated with particular open reading frames, modules, and submodules of the gene enables production of novel everninomicins that are not otherwise available. Modifications may be made to the DNA sequence that either alter the structure or sequence of addition of building blocks. The principles have already been described above. In addition, any product resulting from post-transcriptional or post-translational modification in vivo or in vitro based on the DNA sequence information disclosed here are meant to be encompassed by the present invention.

Combinatorial Biosyntthesis

The EV biosynthetic enzymes described here are ideal candidates for combinatorial biosynthesis to generate libraries of orthomycins, particularly everninomicin analogs and homologs, for testing and drug discovery (see Altreuter and Clark, Curr. Op. Biotech., 1999, 10:130; Reynolds, Proc. Natl. Acad. Sci. USA, 1998, 95:112744). Moreover, unlike chemical synthesis, which may depend on the efficiency of a specific reaction to determine product yield, a biosynthetic system can be amplified and propagated to produce high yields of the desired product.

Actinomycetes are well known microbial biosynthetic factories, and have been modified to produce novel compounds by mutation of specific biosynthetic genes (see Hutchinson, Bio/Technology, 1994, 12:375; Piepersberg, Crit. Rev. Biotech., 1994, 14:251). In addition to mutagenisis in situ, rapid evolution by DNA shuffling, particularly with related genes from other species or from the EV biosynthetic locus itself, provides for more directed evolutionary mutagenesis (Stemmer, Nature, 1994, 370:389). This technique can be practiced, for example, by shuffling EV biosynthetic gene products with their closest homologs, as determined by BLAST (or some other homology algorithm) analysis. For example, gene shifting of two or more transferases can yield new enzymes with altered function. Similarly, sugar biosynthetic genes, orsellinic acid biosynthetic genes, and tailoring genes can be manipulated by the techniques of directed evolution, e.g., gene shuffling, to produce mutants with novel enzymatic and synthetic function. Tailoring enzymes are particularly attractive targets for mutagenesis, since these will not affect synthesis of the core structure, but yield a variety of novel products.

An Integration Vector for Micromonospera

Figure 7A:
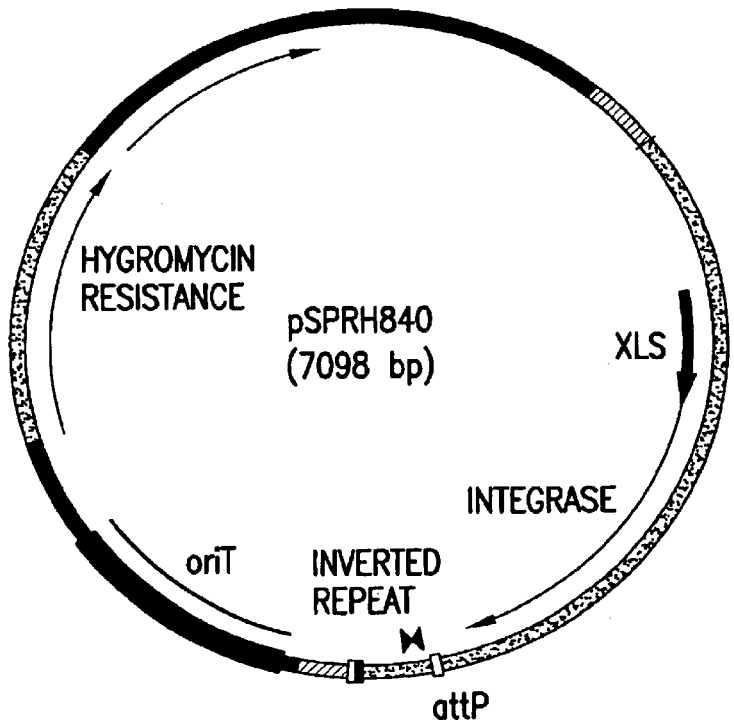
Figure 7B:
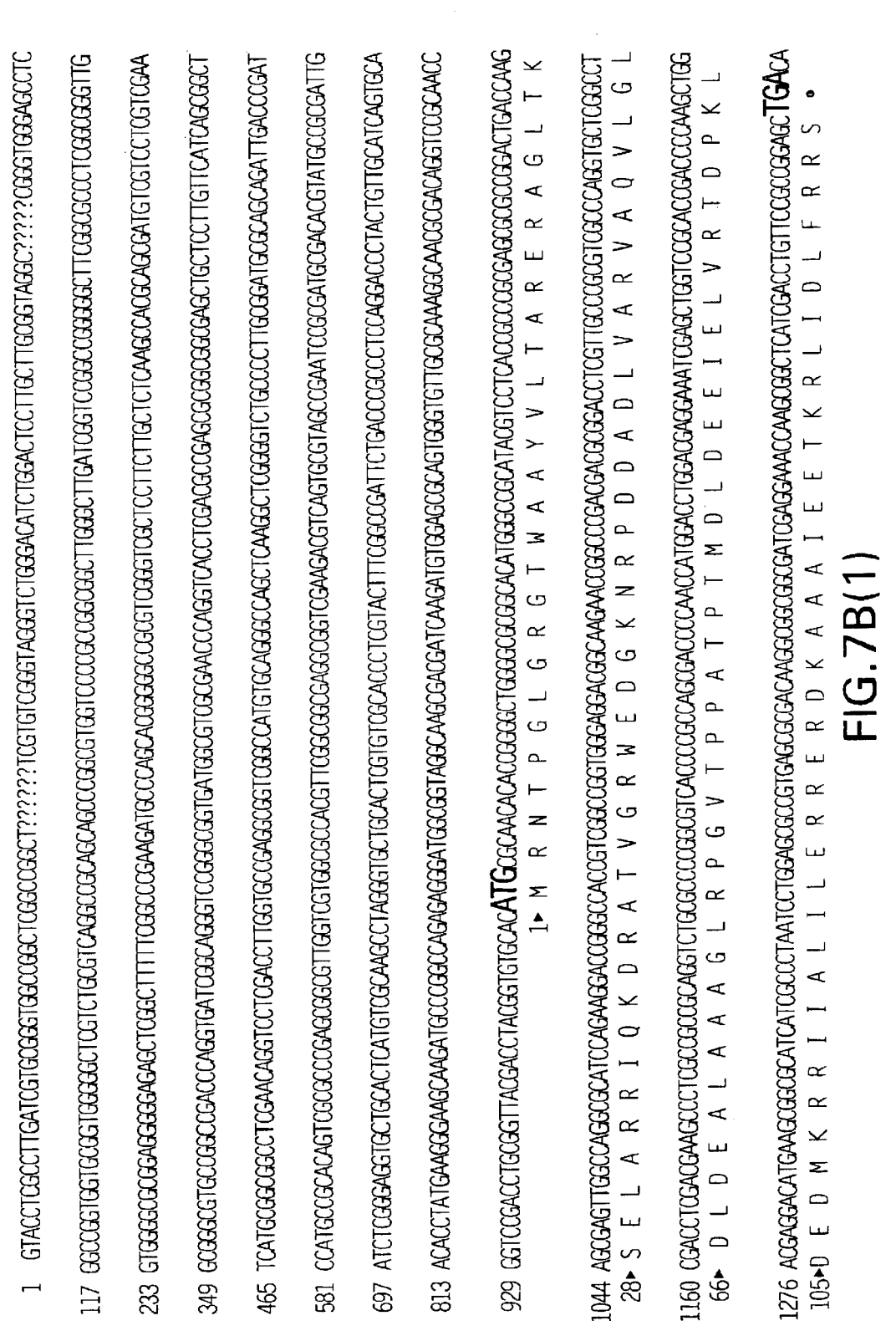
Figure 7B:
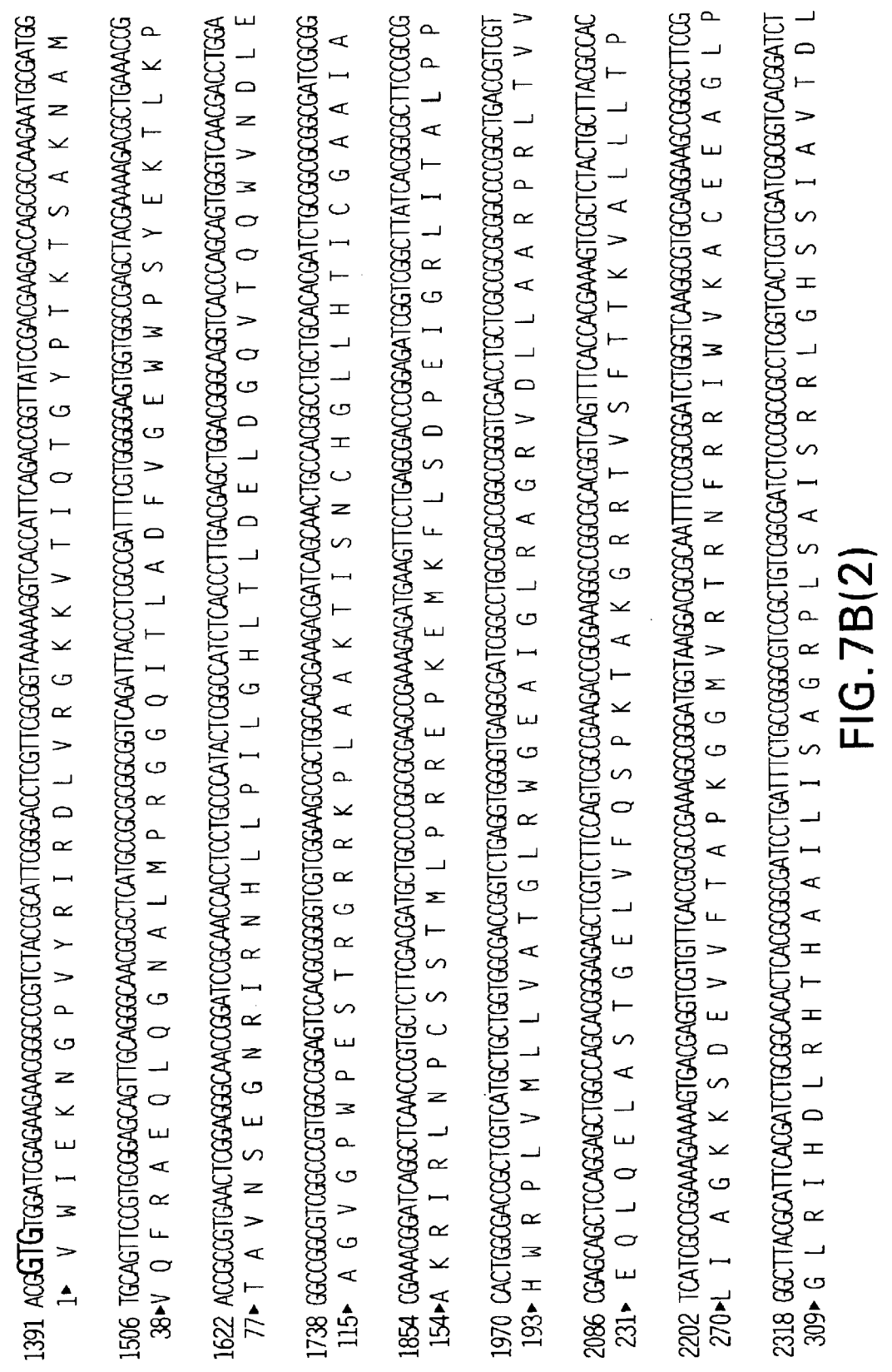
Figure 7B:
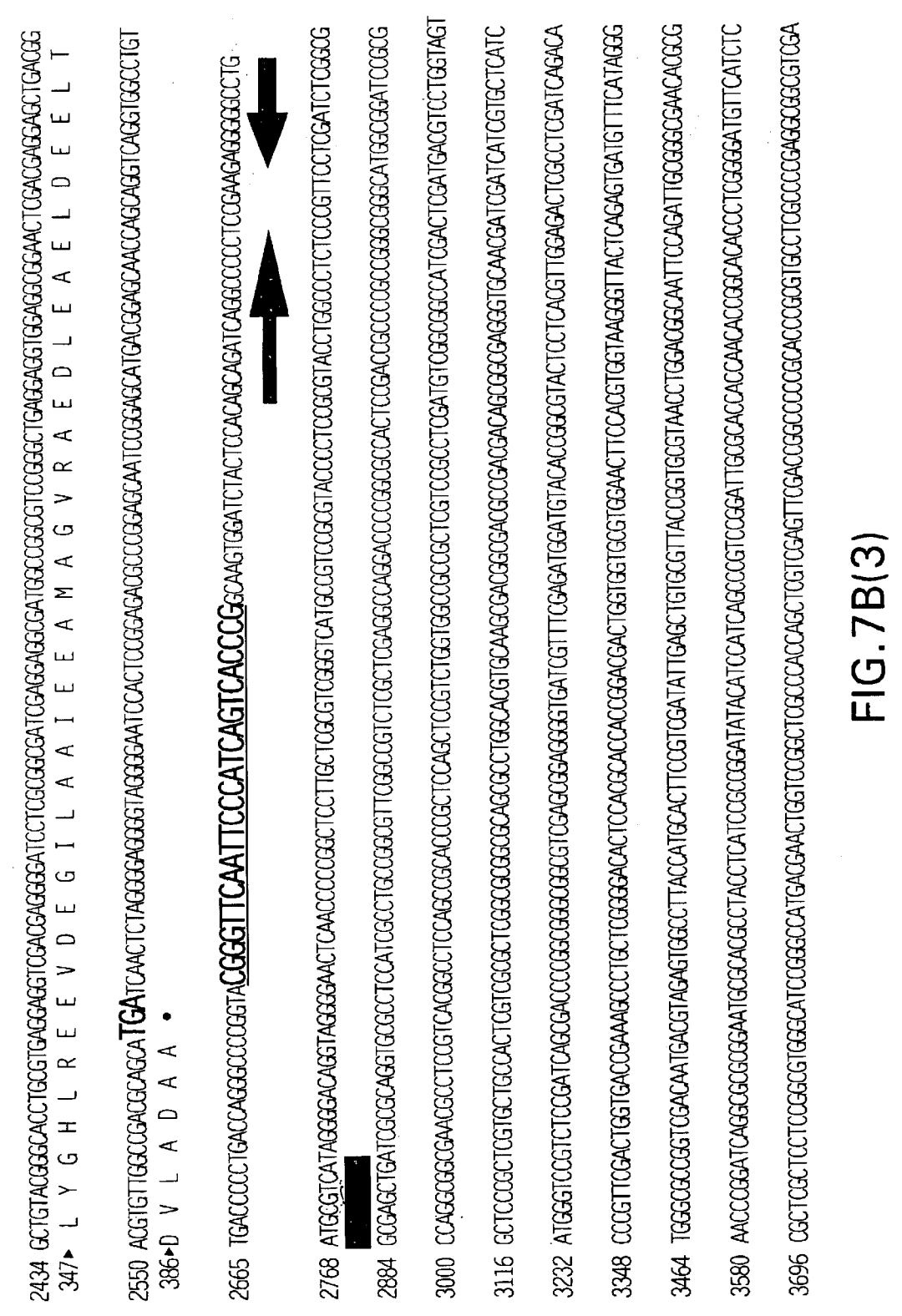

In a specific embodiment, the present invention relates to a new nucleic acid sequence, to vectors for its expression and to its use in fermentation processes in actinomycetes. This nucleic acid sequence encodes a *Micromonospera*, and particularly *M. carbonacea*, var. *africana*, att/int functions and thus permits development of an integrating vector. In a specific embodiment, the attlint functions has an amino acid sequence as depicted in SEQ ID NO: 177. In a more specific embodiment, the integrase is encoded by a nucleic acid having a nucleotide sequence as depicted in SEQ ID NO: 176 (FIG. 7B). A preferred integrating plasmid is shown in FIG. 7A.

Advantageously, the integrative vectors derived from this novel integrase also comprise a recombinant DNA sequence coding for a desired product, including but by no means limited to an EV biosynthetic gene. The product can be a peptide, polypeptide or protein of pharmaceutical or agri-foodstuffs importance. In this case, the system of the invention makes it possible to increase the copy number of this sequence per cell, and hence to increase the levels of production of this product and thus to increase the yields of the preparation process. The desired product can also be a peptide, polypeptide or protein participating in the biosynthesis (synthesis, degradation, transport or regulation) of a metabolite by the actinomycete strain in question. In this case, the system of the invention makes it possible to increase the copy number of this sequence per cell, and hence to increase the levels of production of this product, and thus either to increase the levels of production of the metabolite, or to block the biosynthesis of the metabolite, or to produce derivatives of the metabolite.

Plasmids comprising the site-specific integrating function of the invention can be used to permanently integrate copies of a heterologous gene of choice into the chromosome of many different hosts. The vectors can transform these hosts at a very high efficiency. Because the vectors do not have actinomycete origins of replication, the plasmids cannot exist as autonomously replicating vectors in actinomycete hosts. The plasmids only exist in their integrated form in these hosts. The integrated form is extremely stable which allows the gene copies to be maintained without antibiotic selective pressure. The result is highly beneficial in terms of cost, efficiency, and stability of the fermentation process.

Those skilled in the art will readily recognize that the variety of vectors which can be created that comprise this fragment is virtually limitless. The only absolute requirement is that the plasmid comprise an origin of replication which functions in the host cell in which constructions are made, such as *E. coli* or *Bacillus*. No actinomycete origin of replication is required. In fact, in a specific embodiment the plasmid comprising the inetegrase comprises no actinomycete origin of replication. Other features, such as an antibiotic resistance gene, a multiple cloning site and cos site, are useful but not required. A description of the generation and uses of cosmid shuttle vectors can be found in Rao et al., (Methods in Enzymology, 1987, 153:166–198). In short, any plasmid comprising the integrase is within the scope of this invention.

The integrating vectors can be used to integrate genes which increase the yield of known products or generate novel products, such as hybrid antibiotics or other novel secondary metabolites. The vector can also be used to integrate antibiotic resistance genes into strains in order to carry out bioconversions with compounds to which the strain is normally sensitive. The resulting transformed hosts and methods of making the antibiotics are within the scope of the present invention.

The integrase of the invention may thus be used in any actinomycete, in the genome of which the vector of the invention or its derivatives are is capable of integrating. In particular, they may be used in fermentation processes involving strains of Streptomyces, of mycobacteria, of bacilli, and the like. As an example, there may be mentioned the strains *S. pristinaespiralis* (ATCC 25486), *S. antibioticus* (DSM 40868), *S. bikiniensis* (ATCC 11062), *S. parvulus* (ATCC 12434), *S. glauescens* (ETH 22794), *S. actuosus* (ATCC 25421), *S. coelicolor* (A3(2)), *S. ambofaciens, S. lividans, S. griseofuscus, S. limosus*, and the like (see also, Smokvina et al., Proceedings, 1:403–407).

In this connection, European Patent Publication No. EP 350,341 describes vectors derived from plasmid pSAM2 having very advantageous properties. These vectors are capable of integrating in a site-specific manner in the genome of actinomycetes, and possess a broad host range and high stability. Moreover, they may be used for transferring nucleic acids into actinomycetes and expressing these nucleic acids therein. U.S. Pat. No. 5,741,675 describes tools capable of improving the conditions of industrial use of the vectors derived from pSAM2 by increasing the copy number of pSAM2 or its derivatives, since the free forms are present in a high copy number per cell. This patent also describes cassettes for the expression of this gene, vectors containing it and their use for inducing the appearance of free copies of pSAM2 or integrative vectors derived from the latter.

Alternatively, U.S. Pat. No. 5,190,871 provides methods for increasing a given gene dosage and for adding heterologous genes that lead to the formation of new products such as hybrid antibiotics using plasmids comprising the site-specific integrating function of phage phi.C31.

EXAMPLES

The following examples are provided for illustration purposes only and are not intended to limit the scope of the invention, which has been described in broad terms above.

Example 1
Sequencing of Orsellinic Acid Synthetase

The DNA sequence of the *Micromonospora carbonaceae* var. *africana* (ATCC 39149) everninomicin biosynthetic region was obtained by sequencing inserts of recombinant DNA subclones containing contiguous or overlapping DNA segments of the region indicated in FIG. 2A. All sequences representing the everninomicin region were fully contained in the overlapping cosmid clones pSPRX272, pSPRX262, pSPR192, pSPRX210, and pSPRX256 (FIG. 2A). The sequence was obtained by subcloning and sequencing fragments bounded by restriction site as indicated in FIG. 2A.

Figure 2B:
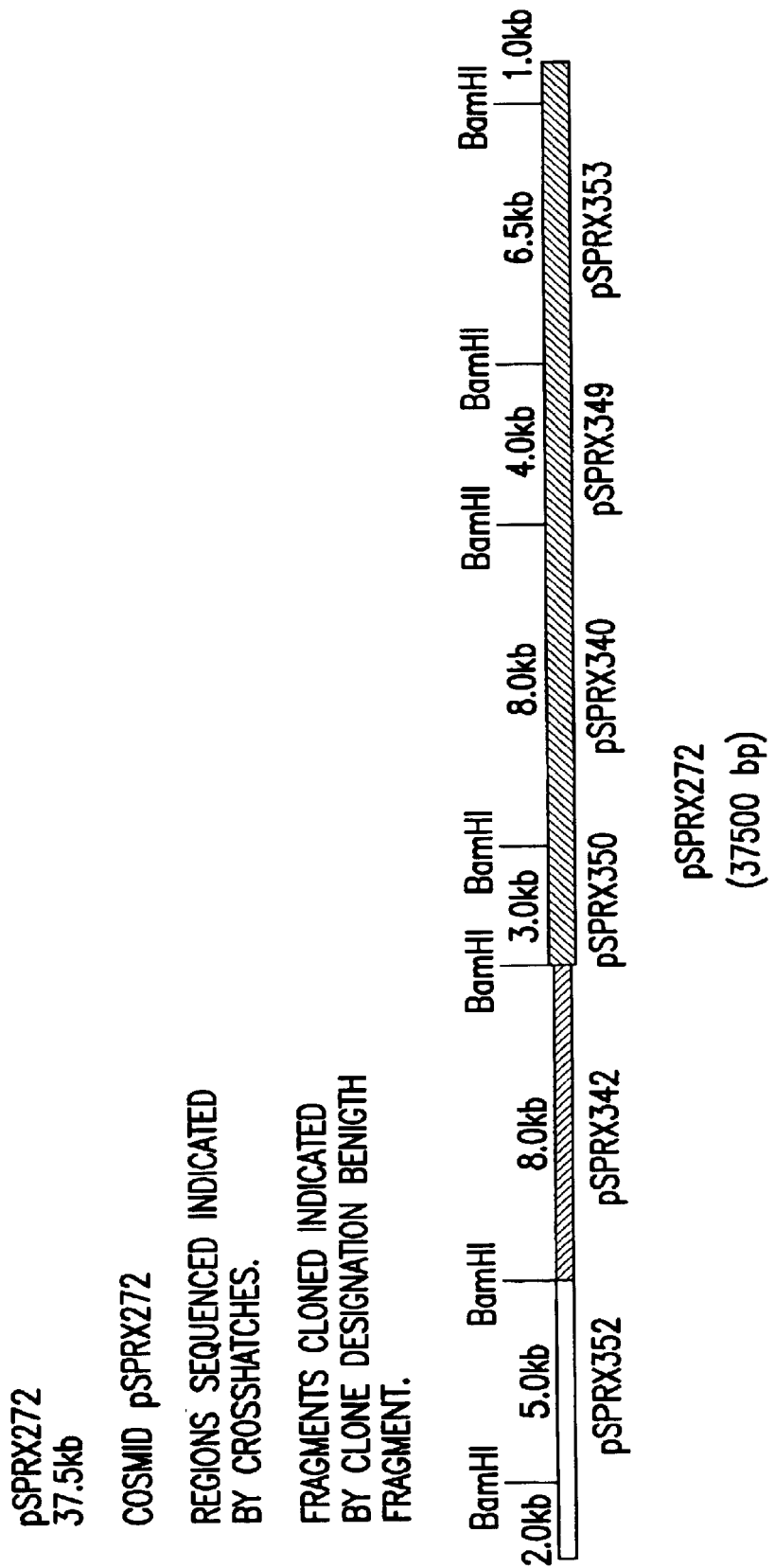
Figure 2C:
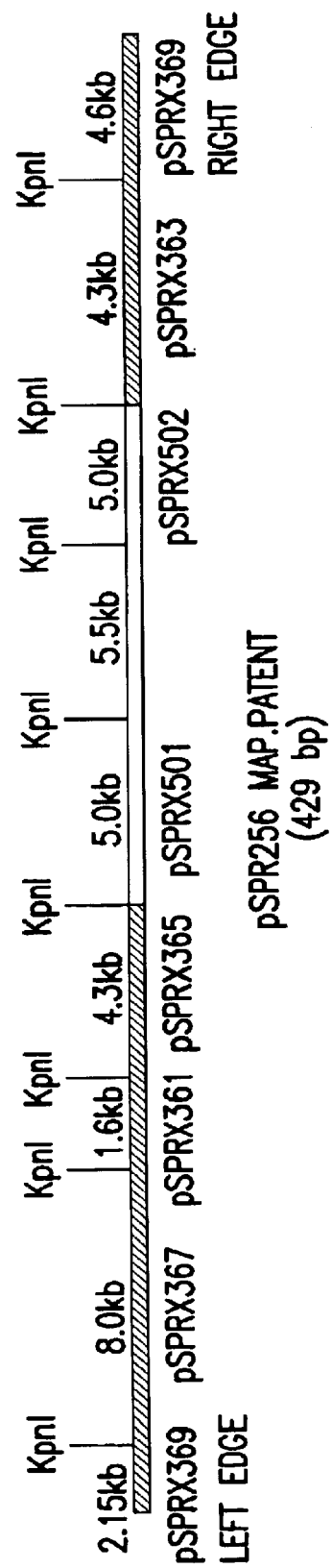
Figure 3A:
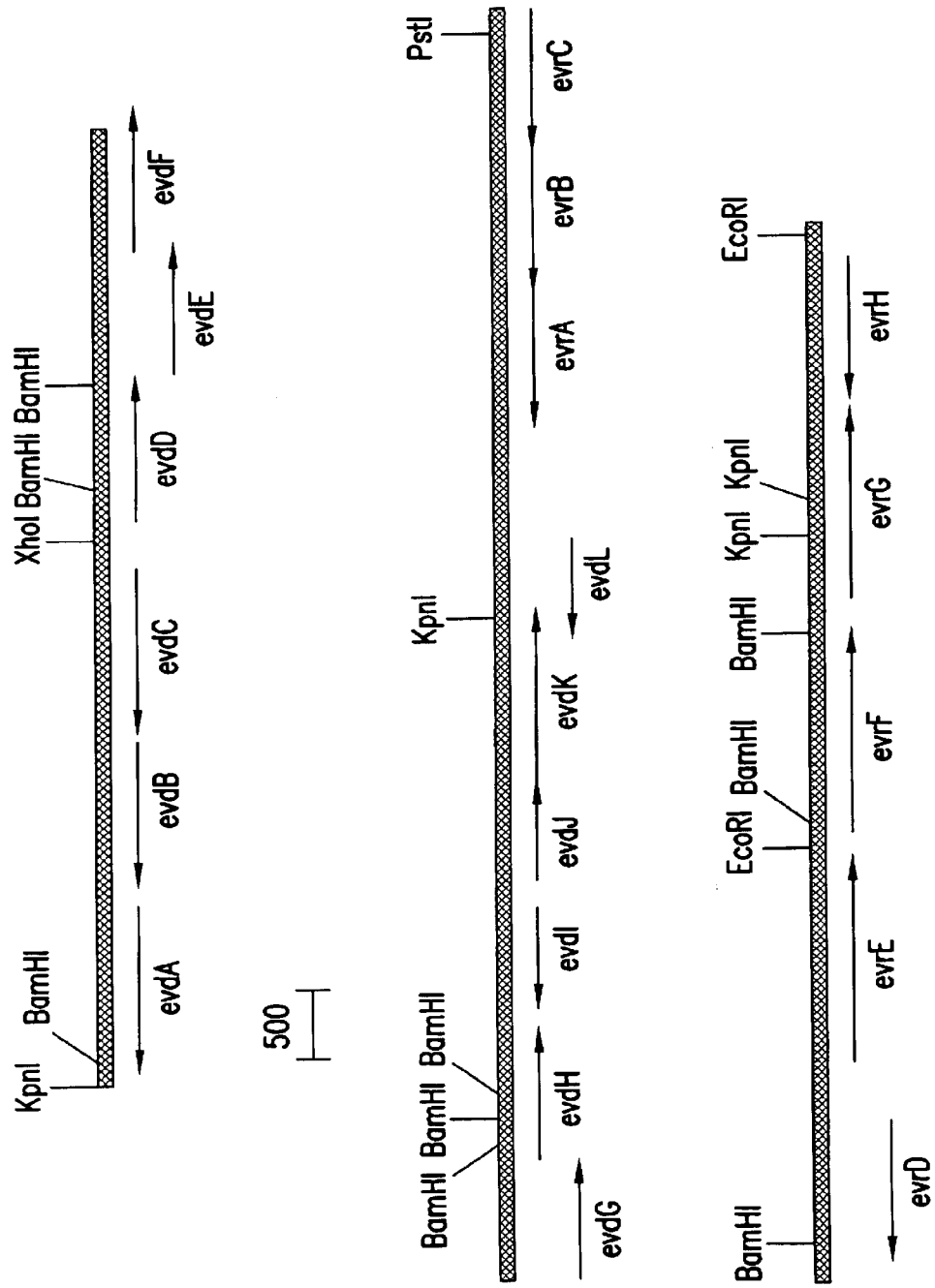
FIGS. 3A–D. Map of the everninomicin biosynthetic region of *Micromonospora carbonacea* var. *africana* DNA. Distances in bf are shown relative to the beginning of the DNA region. Open reading frames (ORF) are indicated by block arrows. The restriction sites for BamHI, Bg/II, EcoRI, KpnI, PstI and XhoI restriction enzymes are indicated.
Figure 3B:
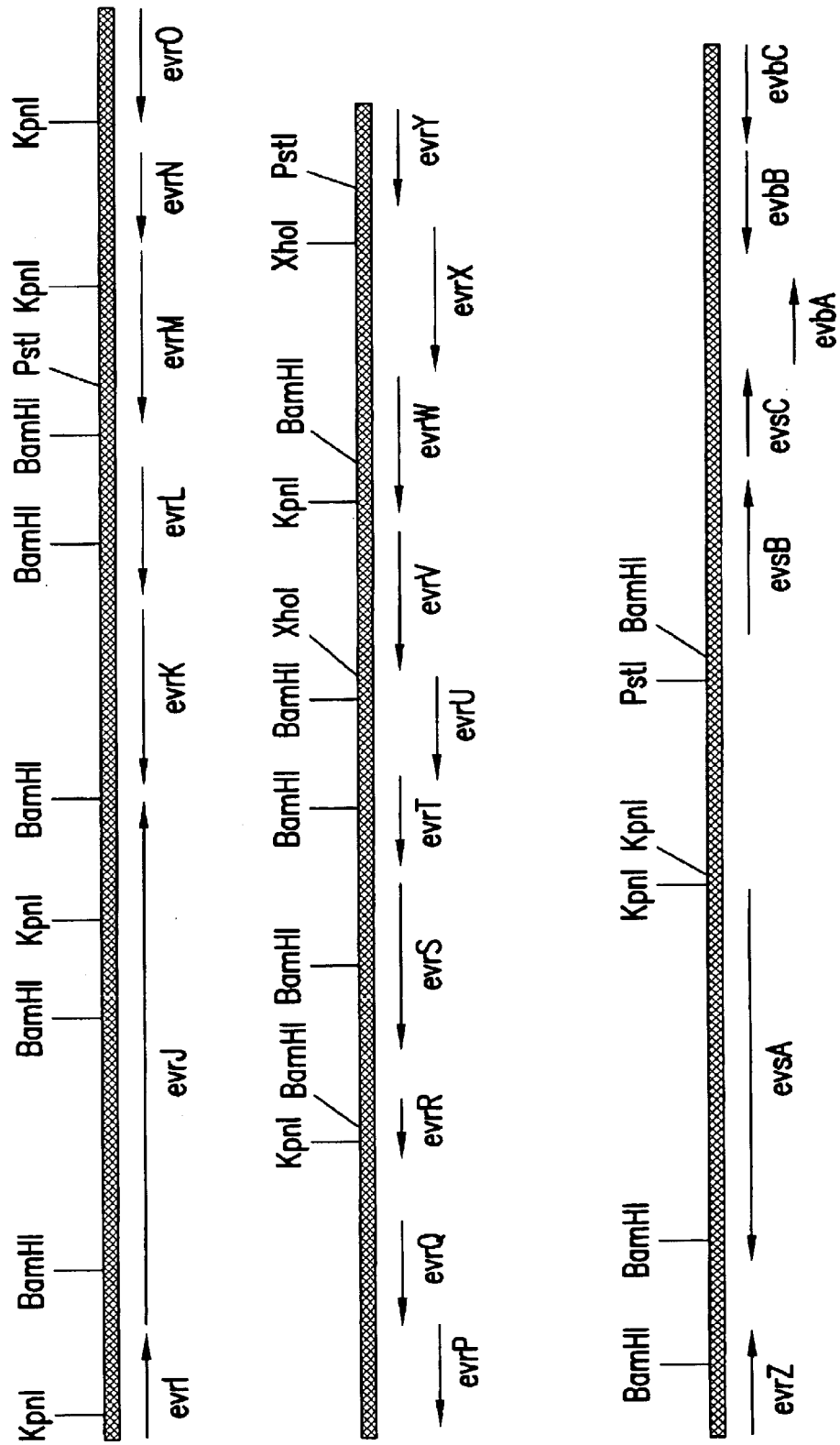
Figure 3C:
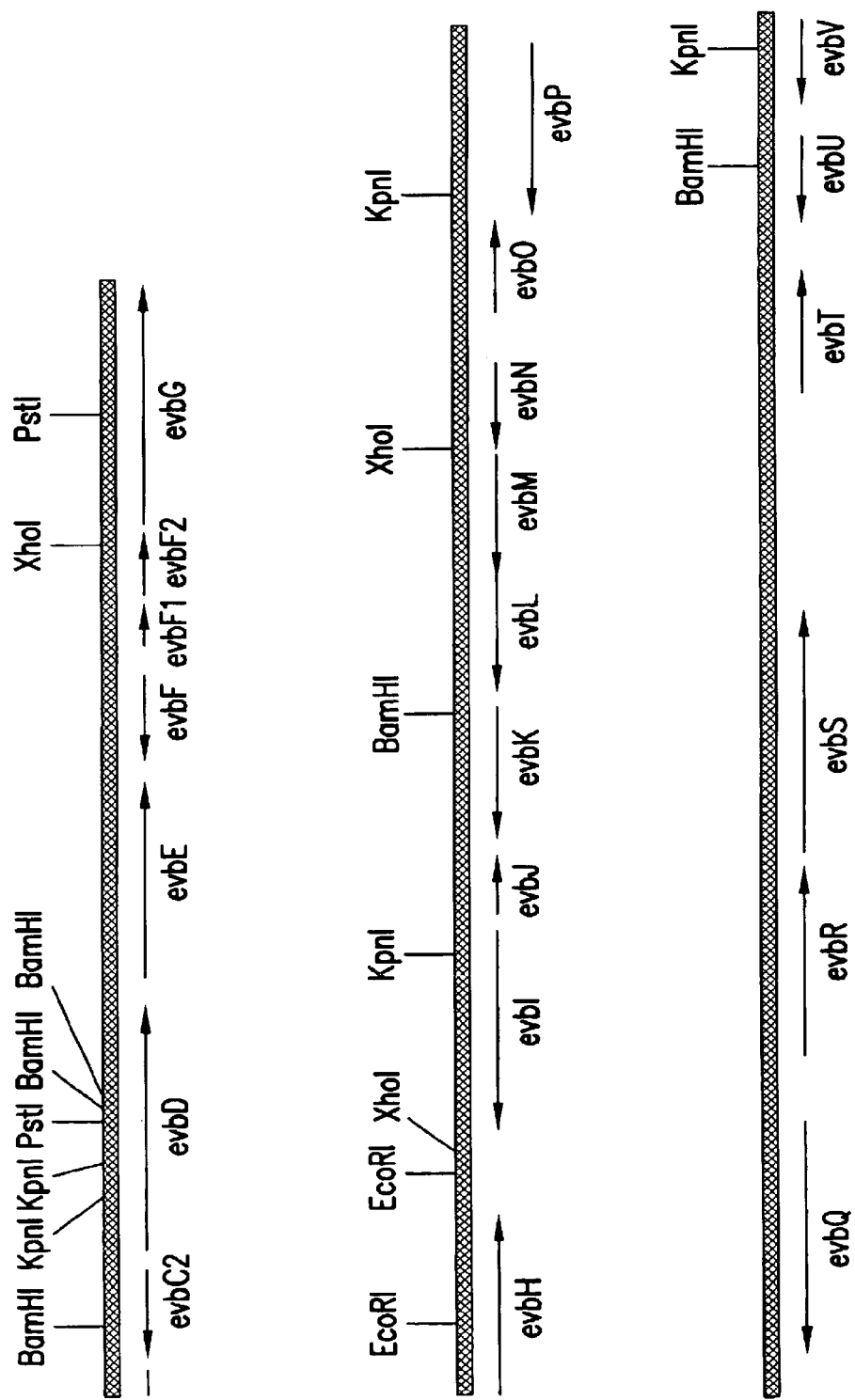
Figure 3D:
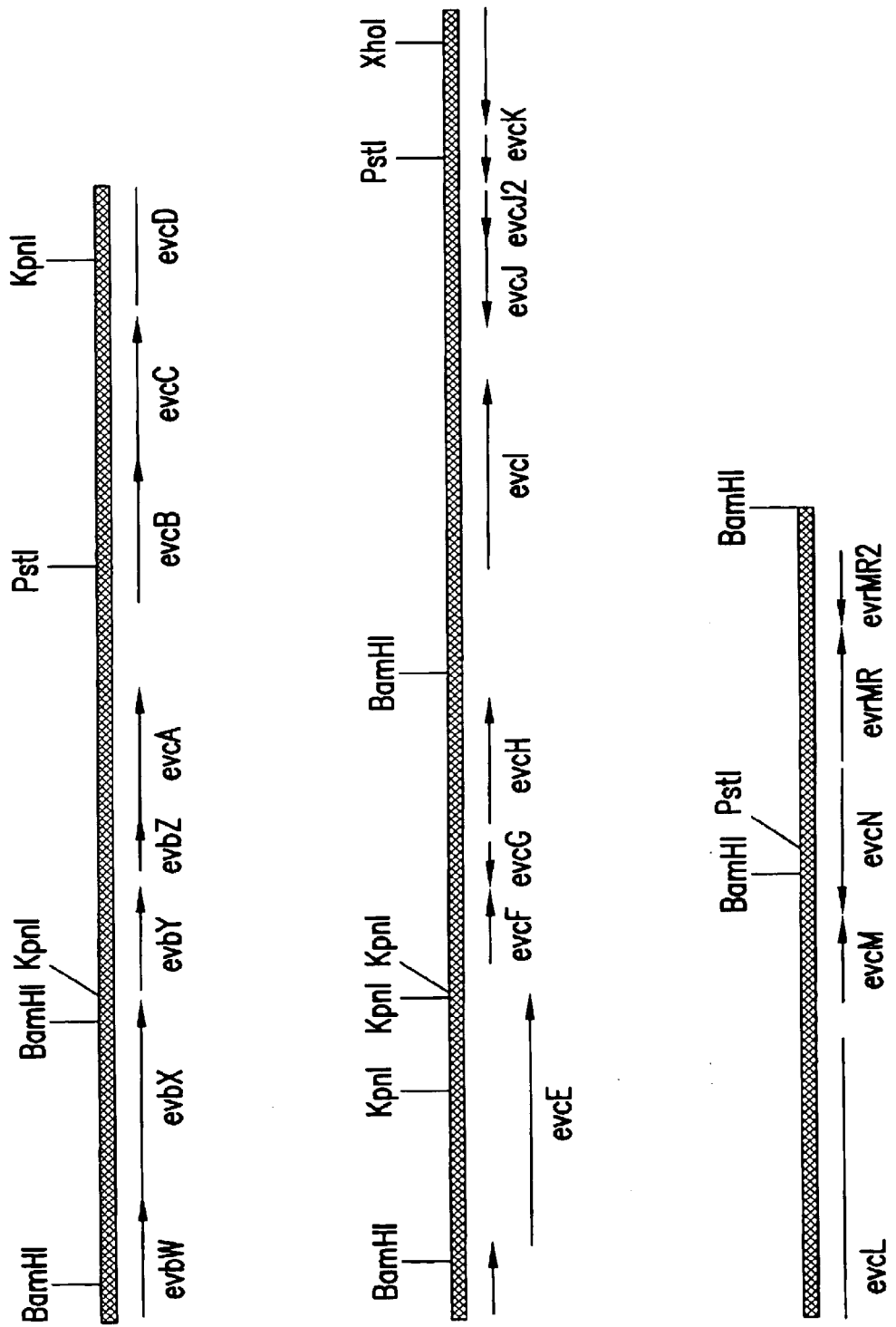

Preliminary sequences were also obtained for the cosmids pSPRX272 and pSPRX256. Restriction maps for these two cosmids are shown in FIGS. 2B and 2C, respectively. These restriction maps are characteristic of these two isolated cosmid clones of the *M. carbonaceae* everninomicin biosynthetic pathway or flanking regions thereof.

In order to obtain the evrJ gene, the sequence can be obtained by subcloning and sequencing of the fragments bounded by the KpnI sites at position 1, 25.9 kb, 29.6 kb, and 34.2 kb. The sequence can also be obtained by subcloning and sequencing of the fragments bounded by the BamHI sites at position 1, 24.5 kb, 27.0 kb, 28.8 kb and 30.5 kb. The resulting fragments should be ligated and cloned in an appropriate recombinant DNA vector. Clones containing the correct orientation of the fragment can be identified by restriction enzyme site mapping.

Example 2
Transformation of *M. carbonacea* with pSPRH830

Figure 6:
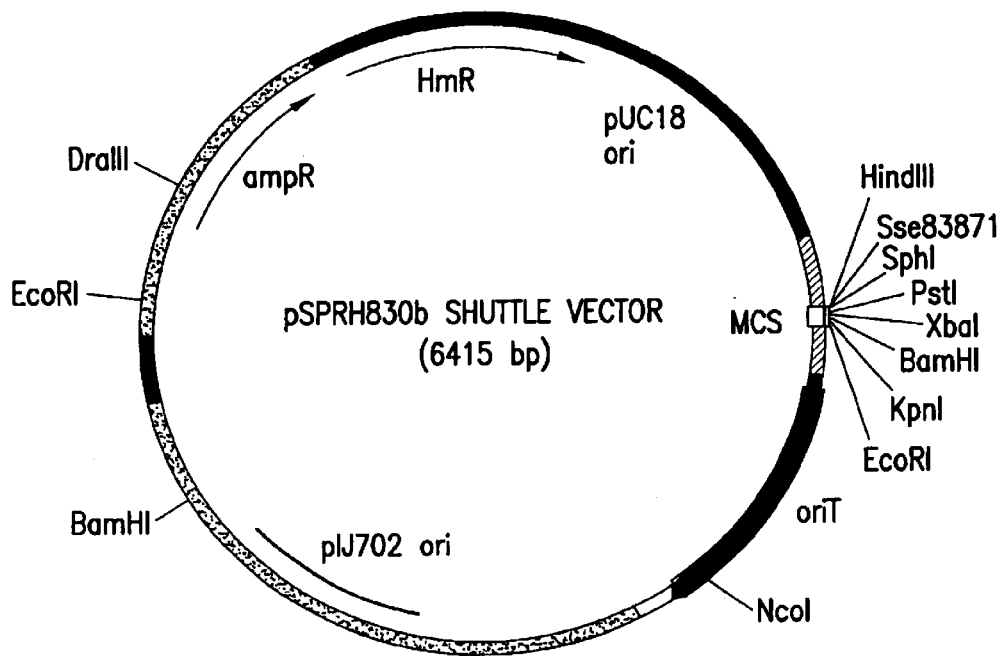
FIG. 6. Map of pSPRH830B *E. coli-Micromonospera* shuttle vector.

*M. carbonacea* was transformed with pSPRH830b (FIG. 6) by conjugation from *E. coli* S17-1 (Mazodier et al., Journal of Bacteriology, 1989, 6:3583–3585) to *M. carbonacea*. *E. coli* S17-1 containing pSPRH830b was grown overnight at 37° C. in LB supplemented with 100 µg/ml Ampicillin (Amp). The culture was inoculated into LB containing 100 µg/ml Amp at an 1:50 ratio and grown with shaking at 37° C. to an $OD_{600}$ of 0.4 to 0.5. Cells were harvested by centrifugation and washed three times with fresh LB lacking Amp. *M. carbonacea* was grown in TSB medium at 30° C. with shaking to stationary phase. *E. coli* S17-1 containing pSPRH830b prepared as described above was mixed with *M. carbonacea* in a total volume of 100 µl and plated on AS 1 plates using a plastic hockey spreader. Plates were incubated for 15 hours at 29° C. and then overlaid with 50 µg/ml naladixic acid and 200 µg/ml Hygromycin for selection. Transconjugants appearing in 2–3 weeks were picked, homogenized and grown in TSB media with 50 µg/ml naladixic acid and 200 µg/ml hygromycin. Presence of pSPRH830b in *M. carbonacea* transformants was confirmed by PCR analysis and isolation of pSPRH830b from exconjugats.

The ability to transform *M. carbonacea* with pSPRH830b (on a multicopy plasmid) allows the introduction of second copies of genes contained in the everninomicin biosynthetic pathway or heterologous or mutated genes into *M. carbonacea*.

Example 3
Transformation of *M. carbonacea* with pSPRH840

The pSPRH840 integrating vector (FIG. 7A) was constructed as follows. A 4.0 kb KpnII fragment from the pSPR150 cosmid containing the *M. carbonacea* pMLP1 intM gene was ligated with BamHI cleaved pBluescriptII (Stratagene) to yield pSPRH819. Sequence analysis of the 4.0 kb KpnI fragment from the cosmid revealed the presence of an integrase gene designated intM, an excisionase gene designated xis, and an integrase attachment site designated attP (FIG. 7B).

BLAST analysis of intM showed homology to other integrases in the NRRL database. Analysis of the predicted attP site showed homology to the attP sites found phage phiC31 and plasmid pSAM2.

Figure 8:
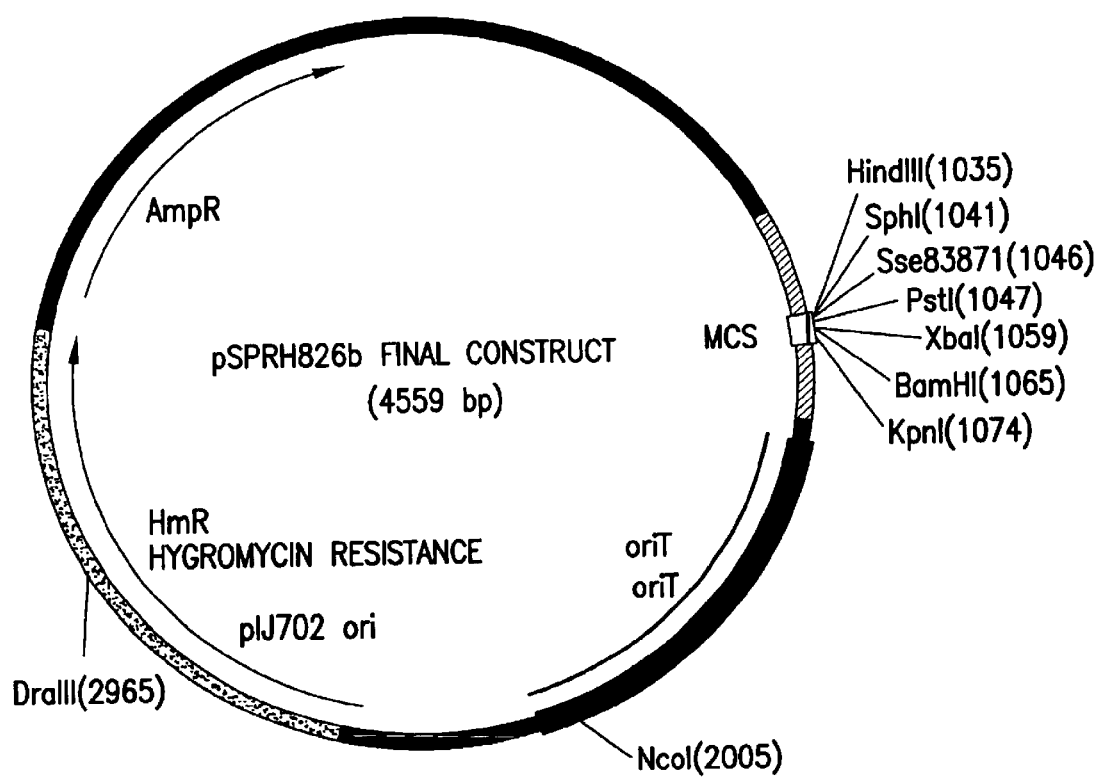
FIG. 8. Map of pSPRH826b insertion plasmid.

A 2.5 kb NruI to XhoI fragment from pSPR819 was treated with T4 polymerase to generate blunt DNA ends, alkaline phosphatase treated and ligated into the pCRTopo 2.1 vector (Invitrogen Corp, Carlsbad Calif.) to yield pSPRH853. A 2.6 kb KpnI to PstI fragment from pSPRH853 was ligated to KpnI and PstI digested pSPR826b (FIG. 8) to yield pSPRH840 (FIG. 7A). pSPRH840 was transformed into *M. carbonacea* SCC1413 and *M. halophitica* SCC760 as described in Example 2. Transconjugants appearing in two to three weeks were picked, homogenized, and grown in TSB medium supplimented with 50 µg/ml naladixic acid (Nacl) and 200 µg/ml Hygromycin. DNA was prepared from transconjugants, cleaved with BamHI, separated by gel electrophoresis, a Southern blot prepared, and probed with radiolabled pSPR826b. Southern hybridization analysis confirmed the presence of pSPR826b sequences integrated into the *M. carbonacea* and *M. halophitica* chromosomes. Regions including pSPRH840 and chromosomal flanking sequences were cloned by digesting chromosomal DNA with PstI or KpnI, ligating digested DNA and transforming *E. coli* XL10 (Stratagene, LaJolla, Calif.). *E. coli* transformants were isolated, plasmid DNA prepared and analyzed by digestion and gel electrophoresis. The attB/attP regions *M. carbonacea* and *M. halophitica* were each sequenced. Sequence analysis of this region confirmed that pSPRH840 had integrated into the *M. carbonacea* chromosome, specifically into a tRNA region (FIGS. 9A and 9B).

The ability to transform *M. carbonacea* with pSPRH840 allows the high frequency integration of second copies of genes contained in the everninomicin biosynthetic pathway or heterologous or mutated genes into *M. carbonacea*.

Example 4
Overexpression and Isolation of Proteins from the EV Region

The coding region of evrF gene was amplified with PCR primers:

```
5' PR 657    CCC TCG AGA TGT CCA GCA AGA TCC TA;    (SEQ ID NO: 178)

3' PR 658    CGA ATT CTC AGG CAG ACT GCT CTG;       (SEQ ID NO: 179)

and

5' PR 659:   CCC TCG AGA ATG TCC AGC AAG ATC CTA;   (SEQ ID NO: 180)

3' PR 660:   CGA ATT CAG ACT GCT CTG CCG CCG C;     (SEQ ID NO: 181)
``` using the Advantage-GC Genomic PCR kit and Advantage HF polymerase (Clontech, Palo Alto, Calif.) and a Perkin-Elmer 9600 PCR machine (Foster City, Calif.). The 1.5 kb PCR products were digested with XhoI and EcoRI and the fragments were ligated to XhoI and EcoRI digested pBADHisA (primer pair PR657/PR658 product) and pBADMycHisC (primer pair PR659/PR660 product) and transformed into E. coli Top10 (Stratagene, LaJolla, Calif.). Transformants were analyzed by plasmid isolation followed by digestion and gel electrophoresis analysis. Appropriate clones were also verified by sequence analysis. This yielded the evrF expression clones pSPRE59 (pBADHisA) and pSPRE19 (pBADMycHisC). Top10 cells containing either pSPRE59 and pSPRE19 were grown overnight at 37° C. with shaking in LB containing 50 ug/ml AMP. Overnight cultures were used to innoculate fresh LB containing 50 ug/ml and grown at 37° C. with shaking to an $OD_{600}$ of 0.4 to 0.5. L-arabinose was added to a final concentration of 0.02% and the culture was incubated for an additional 4 hours. Cells were collected by centrifugation, resuspended in 100 ul Tris-Glycine buffer and boiled for five minutes. Whole cell protein lysate was loaded onto a SDS-PAGE gel, electrophoresed, and stained with coomassie blue to determine protein expression.

To isolate sufficient amounts of protein for raising antibodies, 100 ml of culture was processed as described above and the His-tagged EvrF protein was purified by Ni-NTA column chromatography using the Xpress Protein Purification System (Invitrogen, Carlsbad, Calif.). The recombinant EvrF protein was purified to over 90% homogeneity. This preparation was fractionated on SDS-PAGE gel, excised, and used to immunize New Zealand white rabbits to raise antibodies. Antisera were generated following standard protocol, i.e., priming with complete Freund's adjuvant, (CFA) and boosting with incomplete Freund's adjuvant (IFA).

Example 5

Everninomicin Pathway Expression of Putative Resistance Genes

Figure 10:
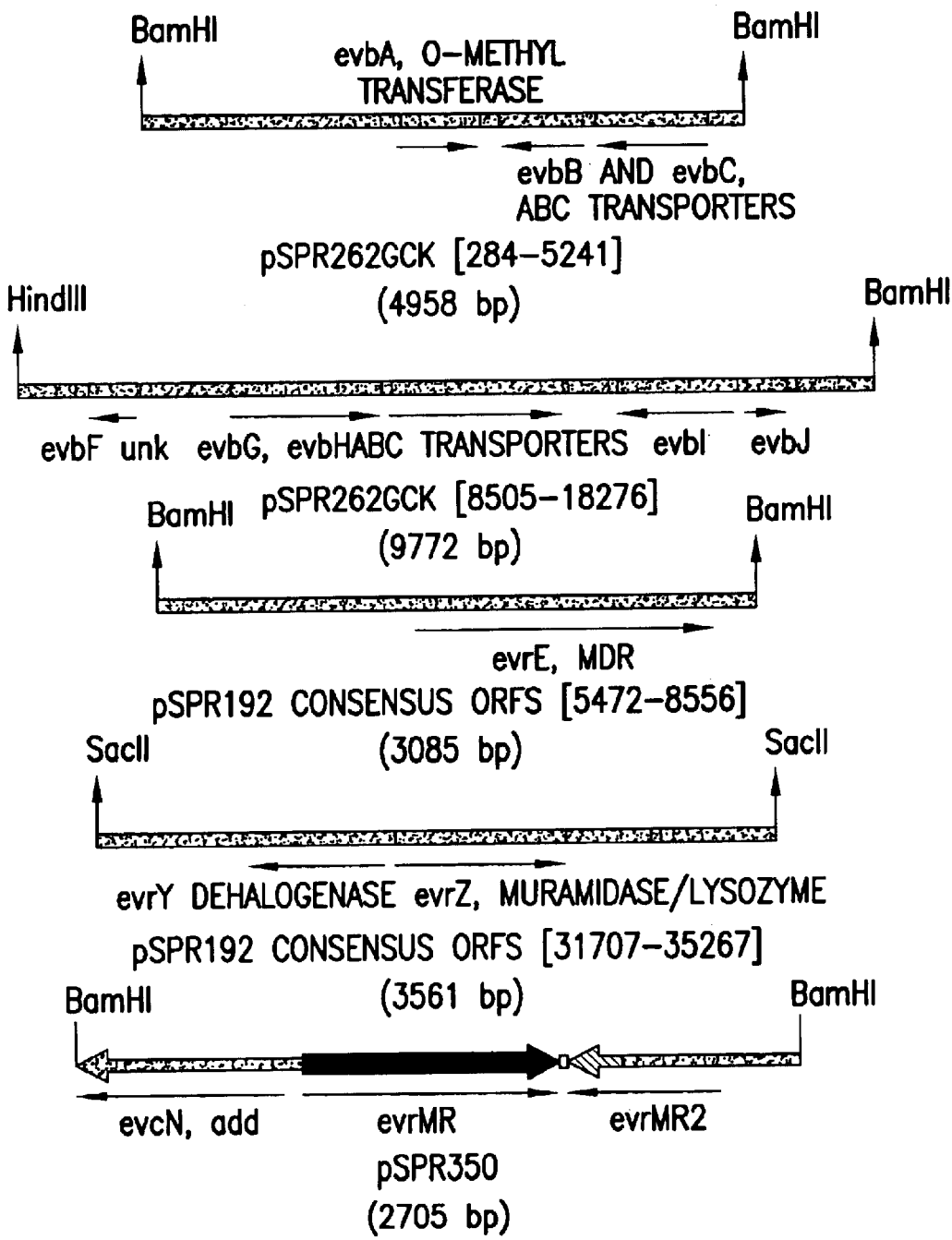
FIG. 10. Schematic of specific resistance gene-containing fragments for cloning in the pSPRH830 vector.

Putative everninomicin resistance genes are expressed in the actinomycete vector pSPRH830b. Clones are obtained using standard molecular biology procedures. Plasmids are transformed into Streptomyces lividans or Streptomyces griseofuscus by PEG protoplast transformation or other standard actinomycete transformation procedures. Transformants are tested for increased resistance levels to everninomicin. A schematic of pSPRH830 the specific fragments to be cloned into is attached and shown in FIG. 10.

The EV biosynthetic gene DNAs to be expressed by this recombinant vector are:

1) 4.9 kb BamHI fragment containing
   evrB, evrC—membrane pumps similar to mithramycin resistance.
2) 9.7 kb HindIII/BamHI fragment containing
   evbG, evbH—ABC transporter pumps, possible resistance mechanism.
3) 3.0 kb BamHI fragment containing
   evrE—MDR (Multiple drug resistance-type pump) transporter, possible resistance mechanism.
4) 3.56 kb SacII fragment containing
   evrY—dehalogenase, possible resistance mechanism
   evrZ—muramidase/lysozyme homology, possible resistance mechansim.
5) 2.7 kb BamHI fragment containing
   evrMR—23S rRNA methylase
6) A PCR fragment containing
   evcD and evcE—ABC transporters

Example 6

Insertional Inactivation of EV Pathway Genes

To confirm involvement of evrJ, (orsellinic acid synthetase) evrF, (halogenase) and evrW (dTDP-glucose dehydratase) in EV biosynthesis these genes were disrupted in *M. carbonacea* via homologous recombination using the conjugative suicide vector pSPRH900b. Internal fragments of evrJ, evrF, and evrW were cloned into pSPRH900b to yield pSPRX572, pSPRX570, and pSPRX589 respectively. Plasmids pSPRX572, pSPRX570, and pSPRX589 were inserted into the chromosome by conjugation from *E. coli* into *M. carbonacea* to yield strains 572X, 570X and 589X repectively. Southern analysis confirmed insertion into the correct chromosomal loci for each plasmid. 572X, 570X and 589X strains showed a loss of EV production as shown by fermentation and analysis by HPLC indicating these genes are essential for EV production.

Production and determination of EV production was determined as follows. A mycelia stock of *M. carbonacea* was inoculated into the seed medium SIM-1 (10 ml) and incubated at 28° C. and 300 rpm. The seed inoculum (5 ml) was then added to 4I+Co production medium (100 ml) and incubated at 28° C. and 300 rpm for 96 hours. A 10 ml aliquot of the fermentation broth was extracted with 20 ml of EtOAc, and the organic phase was evaporated to dryness. After resuspension in 2 ml of MeOH, 10 ml of the extract was subjected to HPLC analysis on a YMC-pack ODS-A C-18 column (3 mm, 150×4.6 mm, Waters Corporation, Milford, Mass.). The column was equilibrated with 3 mM tetramethyl ammonium hydroxide (pH to 7.2 with glacial acetic acid) with 70% (vol/vol) MeOH and developed with a 24-min linear gradient from 70 to 90% MeOH in the same 3 mM tetramethyl ammonium hydroxide buffer at a flow rate of 0.8 ml/min. EV was detected at 270 nm by UV-Vis detection using a Agilent Series 1100 HPLC system (Agilent Technologies).

The present invention is not to be limited in scope by the specific embodiments described herein. Indeed, various modifications of the invention in addition to those described herein will become apparent to those skilled in the art from the foregoing description and the accompanying figures. Such modifications are intended to fall within the scope of the appended claims.

It is further to be understood that all sizes and all molecular weight or molecular mass values are approximate, and are provided for description.

Patents, patent applications, procedures, and publications cited throughout this application are incorporated herein by reference in their entireties.

SEQUENCE LISTING (204 sequences)

SEQ ID NO: 1 - DNA, 109519 bp, Micromonospora carbonacea
ggtacccgaccgtgtcccggaacaacgagtcgagatacggcgagaggaacaccccccggtagtccgggtagacggtgggcgcgaaggcgtacgcgccttcgacggtcagcgggcgggcggacaccggcgggtcagctcgtcacgtgtacgcgggggacgtacaggatccactgtccgccagcccggcggaactcctgctccttcgccatgatctcgtcggcgtggttccaggcgaagagcagcgcgtagtccaccgcgtcgggcgtgaacgcgtccggggtgcgcaccgggatgtgcgtgccgggggtgagccggccctgcttggccggcgtcgtgtcgcacacccaggagaccaggtccggaccgatgccgcagaagttcgtcacggtggcgctcttcgccgtcgcgccgtacgccaccacccgcttgccctcggccttgagcgagttcagcagggcgagcaggtcggtgcggatgccctcgacgtcggcggcgaacctgtcgagccggctgcggtcggcgacccctcgggcgtcctcctcgccgatcagcgcggccacccgctcggccggctgccgcgcgccggcacgggcgatggtgtagcggacctccccaccgtgcaccggaaggcgttccacgtcgacgagcgcgaagccgaagcgggccgccagcgcctgcaccgaccgcgccgagaagaagaagaaatgctcgtcgtagatctggtcgaaggacgtcttgtccaggatgtccccgaggtacgggtcctcgaagacgaagaccccgtccggtgccagcagcgcgtcaacgccccggaggatggagtcgaggtaggggatgtggcagatggtgttggccgcgaagatcacatcggcggggccgtcggtctccctgacccggcgggcggtggactcctcgaagaactcggtgaccacccgcaccccgtgcccacgggccacatcggccaccccacccgacggctcgaagcccaggtgccgcactcccgcctcgtggacggtacgcagcatcaccccgtcgttgcagccgatctccaccacgaacgggtccgggccggtggcctcgtgctccagcaggtgccgcgcggtgtcggcgaagtgcttctgcatcacggaggagcccgacgagtggtacgggtagtcctggtggaacatctcctcccggggcacctcctccatgagctgcaccatcgtgcagcccgcgcagacccccaccgccaggtggaagaagaactcgtccgcgagctggtcctcggtgaggaaccggtcggagagcggctgccgacccaggtcgaggaactgggcggtggtgccgccacacgcccggcaggtgccgcgccggggcgtgccgtcggctgaatcggtcatcgcattccttccatggatacccctgcctcaggcagggcggatgtcaacgacgtctccttgtcgggatgggtcgtccagctctcggctgcggcgtgccggccggcgactcagagcgccgcgagcacgtcgcgcagcgcgtcgatcacccggtcctgcgtctccggcggcagcgagggatacatggggagggagaagatctcgccggccaaccgttccgtggtggggagggagccggtctggtagccgagcttggcgaagccggtcatggtgtgcaccggccaggggtagctgatgttgagcgcgatgtcccgcgccgccaactgttcgaggatgcggtcgcgggcggggtggcggaccacgtagacgtaccagacgtgttcgttgtcggtcgccgtcaccggcagggtcaggccgacctggtcggcgatgtcggccaggccctcctcgtagcgccgggccacggcgcggcgcccggcgatgtagtcgtcgagccggcacagcttgcggcgcaggatctcggcctgcacctcgtcgaggcggcagttgtgccccggcgtctcgacgacgtagtagacctgttccatgccgtagtagcgcagccgccgcagccgctcgtcgatcacggcgtccgcggtgaccacgccgccgccgtcgccgtacgcgcccagcaccttcgtcggatagaacgagaaggcagcggcgtcgcccatcgtgccggccagccgtccgccccgacgcgcgccgtgcgactgcgcgcagtcctccaggaccttgaggccgtgttcccgggccacccgcagcaccgggtccatgtcgacgcactggccgtagaggtgcaccggcagcagcgccttcgtccggggggtgaccgcctcggccagcagctcggtgtccatcaggtagtcgtcggcgcggacgtccacgaagaccggcgtcgcgccgaccgcgtcgatggcgagcaccgtcggcgcggccgtgttggagacggtgatgacctcgtcgcccggcccgacgtcgagcgcctggagtgcgagcttgatggcgttggtgccgttgtccaccgtgacgcagtgcggcatgtcgtgataggcggcgaactcctgctcgaagccgcgcacgctcgcgccgaggatgaggttcccggactcgaagaccgtctgcacggcgtcgaggaggtcgtcccgttccttctcgtactccggcaggtagccccacactcggatggtcatcttcgcccttctacgccgaggtccgggagcggagcgcgcgcacgctcatgtagtcgttgtcccggtcgagtccaagtgcctgaccgctcaggtagtcgacggcgtccacgtagctgtagggctgcatgaacccgccggcccgcacgtcgcgatagagccgggagagtgggtgcccggccgtgtaggcgaggccgccgaccaggctgaggcagtcgtccaccaccgccggggccagctcgttgacggtcatcttcgcgtactggaacggggtcatcatccgtcggccgcgttcgtccgggtcgccggacaggtcgaccgacgccgcgtcggcgttggtcaacgccgcgccgaccgtggtgcgtagcgcgtagagccgggtgtccagcccggcgaccagcgcccgggcaccggcccgtggctcgccgccgcgccccgcgcagaaaccgaccgcgatgtcccgggccgcctgggcgatgccggcgtagatgccgagcatggtgatcgagctgaccgtctgcccggccagcacggcgtcccgccgggccccgaccgggccgcgctccagcagctcgtcggcccggaccgggcaccggtcgaagaccacctccagcgtccccgaggcacgcattcccaggccgtcccagttgtccagcaccgtgagcccgggggcgtcgcggtgcacgaccggcacggcgaggaacaccgagccgtcgtcgtcgcgccgctgggcgtgcacgaagaagtgggtcgcgatgggcgccatgctgaccagcaccttgcggcccgacagcagccagccgccggcgccgtcggaatgcagctcggtgaccacgccgggggcgtccttgagcgcgccgcagacggcggcctcgccctccgccatcgcccgcagcagccgctccgccatcgcgcgcaccggcggcgtgccgtgctgccactcgtaggtgagggtgaggccccggctgagctgcacgtgccaggccagcgcggtggacgcgtcggcctcggccagccgcatcagcgcggtcgccacgtcgtacagccgggtcaaccccaggccgcccagctcggcgggaacggtggcgcccatcaacccgagcttcgcgaactgctcgaacgcctccaccgggaaggtgccggtgcggtcccggtcggcggcctccgcactgattctcgggatcacgccggcaagcaggtcgaccaccgtgcgccccgccggcgtgagcggcgcgcgaagatccgccgccacccatctctcctcggtcagattagacatcgcctgcttccgttcgcgctgtgccgaacctgtcgctatcagggtgcgcggcgatcaccaattgctggctgattgtccaccgacgatgctcgacagggatacccagaataggcggcaacggcttggcgaaacccctgtcgtgcgccggagttcgccaagtctagttggatcactcgagcttcccccgcagaagccgtgaaccatgggccagcggttgacgtcgctatatattcggccgacacgtgcggaggactcgtgaagatactgttcatcgcaggaccgacgaagtccagcctattcggcctggccccactggcaatcgccgcccggatgagcgggcacgaggtcgtgatggcttccacgcaggaggtcgtaccggcgacgatgtccgtcgggctgccggccttcccgctggcggcgctgaccctcgccgagctcatgaccaccgaccgggccggcgatccgctgcgcatcccggccgaggacgccgccttcgtccccttcgtcggccggatgttcggccggctggcggcgatcagcctggatccgctgcgcgacctggtcggcgggtggcggcccgacctgatcgtcggcggcccgcacgcctacgccgcgccgatcctggccaccgaacttggggtgccctgcgtgcggcacctgctcaccggcaacccggtggaccgcgagggcacccatccgggggtcgacgaggagctgcggccggagctggccgcgctcggcctggcccaggtgccgccgttccacctggccctggacatcttcccggccagcacccggatcgacgacgtcccgccggcgcagccggtgcgaccgctgcgctggattccgaccaaccagcagcagccggtggcgccgtggatgctctcgcgcgggccgcgtcgccgtgtcctggtcaccgccggcagtctggtcaccaccacccacaacttcgacttcctccacggactggccggcaccctggccgagcaggacgtcgaggtcgtggtcgcggcgccgccggaggtgggtcgggccctgcacgacgtgccgggtgtgcggcacgccggctggctcccgctggacgtggtgctgccccactgtgacctgatcgtgcaccactccggcacgatgaccgcgctgaccgccttgaacgcgggggtgccccagctgatcgtgccgcaggagagccggttcatcgagtgggcgcgcaacctgtcgaccctgggcgtggcgcagaccctcgcgccgggcgaggacacgccggaggccgtgggcaaggtcgcccgcctgctgctggaggatccggtccacgccaccagcgccgccgcgatcgcccgggagatcgccgagatgcccggccccacggaggtcgtgggccagctcaccgagttcgcgacccggggcctgacatgcgcgtcctcgtgaccggcggagccgggttcatcggctcccacctcaccgacgcgctgctcgaacgcggcgacagcgtcaccgtgctcgacgacctgtccaccgggcggcccgagcggctgcccgccggggtgccgctgcaccacgggtcgatcaccgaccgggccgggttgacccggctggccgagcagtgtcgcccggaggtcatctgccacctggccgcccaggcggacgtgcgcaactcggtggccgacgccacctcggacaccggggtcaacgtggtcggcaccgtcaacgtcctggaggccgcccgggccatcgacgcccgggtggtcttcgcctccagcggcggcgccctctacggggaggtcgacgagctgccctcccccgaggacgtccggccggcgccgtgggcgccgtacggggccgccaagtactgcgcggagcagtacctggcgctctacaaccggctctacggctcgacccacgcggcgctgcggctcggcaacgtgtacgggccacgccaggacccgaccggcgaggccggggtcgtctcgatcttctgcggctgcctggtggccgggcgccggccgacggtgttcggcgacggcgagcagacccgggactacatctacgtggccgacgtggtggaggcgttcctgctcgcggtcgggcacggtggccccggcctgtggaacatcggcaccgggacctccaccagcatccgcaaactactggacctggtcggccgcaccgccgggcgcgtcccggacccccgcttcgagccaccccgcctgggcgagctgaagcactccgcgctggaggtgacccgcgcggcccgggagctgcgctgggcggcccgaacgaggctcgccgacggcatcgcgaaggtctacaagtgggtcgaggcggacgaaccggtccggggggagcgatgacccgcgaggggtcaacgccgccggttagggtcgccaccatcacggtcggcaccaacgagatccgttggctggaccgcgcgctcggctcgctgctcgccagcgacacgaccggcttcgagctgacggtcttctacgtggacaacgcctcggccgacggcagcgtggcgcacgtcatgtcggcgtttcccggcgtccgggtcatccgaaacccccgcaatctcggcttcaccggcgcgaacaacgtcggcatgcgggcggccctggcggagggcttcgaccacatcttcctggtcaacccggacacctggacaccgccggggctggtccgcgggctggtcgagttcgcgcagcggtggccgcagtacggcgtcatcggcccgttgcagtaccgctacgacccggcgtcgaccgagttgaccgacttcaacgactggacgcaggtcgccctctacctgggcgagcagcacaccttcgccggcgacctgctggatcatccctcgcacgtcaccgcgacggtccgcgaccgcgcgccgcgcaccctggagcacgcgtacgtgcagggctcggcgctgttcgtccgggccgccgtgctacgcgaggtcggcctgctcgacgaggtgttccacacctactacgaggaggtcgacctgtgccggcgggcccggtgggcgggctggcgggtggcgctcctactcgacctcggcatccagcacaaaggcggcggtggcaccgccgcgagcgcgtacagccggatacacatgcgccgcaaccgctactactatctgctgaccgatgtggactggcccccggccaaggccgcccggctcgccgcccgctggctgttctccgacgtccgtgggcggggcgtgacgggtcggacgagcgcgggcgtcggggcgcgggagaccttcgtggcgctcgggtggctggcccgccaggccccggtgatccgggaacgtcgtcggcggcaccggctgctgcgggcacgagggacgggcgtggaccgcgcccgagagcggaaggaaaccgtgcggggatgagcaggccacggattctcgtcgcgggcaacttccactggcaggccgggttcagccagaccgtcgccgcgtacgtgcgggcggcccgggaggccgactgcgaggtgcggctctgcggcccgctgtcccgggtcgacgccgagacggcccggcacctgccggtcgagccggacctccgctggggcacccacctggtgatcatgttcgaggccaagcagttcctcaccgaggcgcaactggacctcgtcgaggcgttcccccgacagcgccgggccatcgtcgacttcgacgggcactggggtgccgaggagggcggggacggcgacagcgcgtcgggccggtactccgcggagagttggcggcggttgtactcgaccctgagcgacctgatcctgcaaccccggctgggtccgctcccggccggcgcccggttcttcaagtgcttcggcctggcagcgccggtgcggcacccgctggaactgggcaccggcgcgcagtcgcgcccgtacgacctccagtacatcggcagcaactggtggcggtgggagccgatgaccgagatggtcgaggccgcggcggcggcccggccgccgctgcgccggctgcgggtgtgcggacgctggtgggacggcggcagttgcgcgggcttcgaggaggcgacgctcagcgagccgggctggctgcgggcgcgcggcgtcgaggtgcatccgcccgtgccgttcggccacgtggtcgagcagatgggccggtcgctgatctcaccggtcctggtgcggccgctggtcaccagcaccggcctgttgaccccccggatgttcgagacgctggcctcgggcagcctgcccgtgctcccggtcgccgcgaagttcctcgcgccggtctacggcgacgaggcggaacacctgatgctcggcgacgacccggccggaacgctgagccggctctcggccgagcacgaacggtacggacgactggtcggtgagattcaggaccggctccgcgtcgagtacggctaccctcgcgtcctgcgggacctgctcgatctgctggcctgaggaatgaggagcagatgacccccctgcggatcgcgatggtcaacataccgttccggttgccgagcgacgagcggcagtggatcacggtcccgccgcaggggtacggcgggatccagtggatcgtggccaacaagatcaagggcctgctcgaactcgggcacgaggtgttcctgctcggtgccccgggcagtccgcgtacgcatccacgcctgaccgtggtgccggcgggcgagcccgaggacatccgggcatggttgaagtccgctccggtggacgtcgtcaacgactacagctgcggcaaggtggatccgatcgagctgcccccgggggtcggcctggtggcctcgcaccacatgaccacccgcccgtcctatccggccggctgcgtgtacgcctcgaaggcgcagcgggagcagtgcggcggcggcgcggacgccccggtcatcccgatcggggtggatccgtcgctctaccgccccggcgaccgcaaggacgacttcctgctcttcatgggccggatctccccgttcaagggcgcgctggaggcggccgcgttcgcccgggccgccggccgccggctactgatggccggtccggcctgggagccggagtacctcgaccggatcatgggcgagtacggcgaccacgtcaccctcgtcggcgaggtggggggtcaggaacgtatggacctgctcgccacggcggctgccatcctggtgctctcccagccggtgcccggcccgtggggcggcacgtggtgcgagccgggtgcgaccgtggtgtccgaggcggcggccagcggcaccccggtggtcggcacgagcaacggctgcctggcggagatcgtgccggccgtcggcgaggtggtgggcttcggcaccggcttcgacgagcgggaggcccgagcggtgctgtcccgactgccgtcgcccgcccaggcgcggaaggccgcgatccggtgctgggggcacgtggagatcgcccggcgctacgaggcggtgtaccgcgacgtgctggccggcgcgcgctggtcctgagccggcccgggcggcggctacggtcgcgaccgtagggggtgcccgccgcacgcggaagcgccggtgtcggcggtccgacaccggcgcgcccggccaggtcagctccggtcgtgcagccagggtcgcggctcggggtcggtcacctcgaccggctggctcatgaacaccaggacgtacgcgcggcgcggctggtccgtctcgttcgggccggcgtagtgcggcgcacggaagtcgtgcatgaccgcctcgcccggccgcagcgggcaggcgacgctgtccgtgtcgtcgacctcgtccgtcatcagaccttcgatgcggtcgtcgtggttgatgtgatggtgcgggagcaccccgccccggtgcaggcccggcaggtactggagacagccgctggacaccgtcgcctcgtcgagcggggtccagatgctcaggccgcgacgggaccagcgcgggtccatgtacgcctcgtcctggtgccacggagtgggtgcgccgtagcgcggcggcttgaggatcgcgtggccgtagaagtcgagttcgtcctcggggatgtcgaggaaagcggaggcgatggcccggcatcgcgcgaagtgcgcggtctccaccaactccggcaggtatttctccggccggacgatctgcgggagacgggcaggcgcggcgtcgtcgccacggccggcgatgtcccggtagtcgccggtgtcgggcgacgcgtgatcggcgaagagccggtcgtaggcggcccggagccaggcgacctcggcgtcgtcggcgagctgcgggagagtcacgaagccatcgcgccggtaagcctccagccgacggtcgacgacctccgcaccaacagtccccacggccatttgaccacctctcggaatagcctgtccgcgaataaaccatacggtaggaacagcgcggcgataccgctcccgagcgggaaatagggattcgactagtattcggtccgcgccgctgccagaacggcacgcgctctcgattgtccattcatccccgtgcgagactcgcctcgatgtcctcgatgtcggtggggggtttgggatgaccgggcacagcgccgtcgcgctggacgtcggcggggtcgtctactacgacgagccgttcgagctggcctggctccaggacaccttcgaccgcctccaggccaccgacccgacgctcgacctgcgtgcgtttctggagcacgtcgagcggttctaccactacggcgagggcgacccaaccggccggacctggctccactcggaggccgccgcgctgagctggtcgcgggtccggcagtcctggggcgagctggcccaggagattcccggtgccgttcgcgcggtcaccaggctggccagggaactacccgtcgtgatcgtcgccaaccagccccccgagtgcgcggacgtactggcccggtggcaggtcagccaggtctgccgggaggtgctcctcgactccctcgtcggggtggccaagcccgacccggccctgctcgggctcgccctgcggcggctggcgatcccgcccgccgagttgctggtggtgggcaaccggacggatcacgacgtcctgcccgcgctcgggctcggttgcccggtggcgttcgtgctgcccgatccggcgtaccgccggccgccgggcgtccatccggacctggtccgggtctacacggagctgagggcgttccgcaccggctccccgcccgcggacgcccgggtcaccaccgtggcgtccctggcggccctggccgactctcccctgacgagtgccaccccgcgttcgaacgccggcaccggcggactttgacgaaggagtgcagttgcgacgccccgcagcggtggtcggcgccaccggcttcatcggctcacgcctcgtctcccgcctggccgaggccgggcatccggtggcgcgcttcagccgtgccgccccacccgtcgtcgacggccggcccgcgccggggctccgcgaggcgcaggtcgtctacttcctcgccgcccggctgagcccggcgctggcggagcagcaaccggaacgggtcgtccgggaacgcgagttgttgctggacgtgctaagtgcgctggcgggggtggaccaccggccggtgttcgtcctggccagctcgggcggggcggtgtacacgccgacggtgtggccgccctaccacgagcggtcggccaccgggcccgcctcggcgtacggccgggcgaagctgcggctggaacaggagctgctgcgccacaccgaccgggtgcagccggtggtgacccggctgagcaacgtctacggtccggggcagcggccgacccccgggtacggtgtcctgtcacactggctggaggccaccgtgcgcggagagccgatccggctcttcggcgatccggccgtggtgcgggactacgtacacgtcgacgacgtcaccgcgatcatggaggtcatcgcgcagcgggccggtgacggcgaccgggaccggctgcccacggtcgtgaacgtcggctcgggcctgcccacctccctcgccgagttgctccagacgatgtccacggtggccggtcgtgagctggaggtcatccgggacgtccgccggcagttcgaccatcggggcaactggctcgacaccaccctcgcccgggagaccctgggctggcaggcgcggatcagcctccccgacggcgtccgccagtgctgggaggccgtcctcacccgggcgggcggcccggggggttccccggcccgaccgtcagcccggctcgggagagcgtctcgggggcgggaaccgccgcaaccgcgcccttcgcagcagttcgtggctcaacccggcggcggtcgccgcggtgtagccgagggccagtggcagggcgagccgggattccggggccgtacggtgccggtcccattccttgcgcaggccggcccgtgcctggttccgtccggcctcgcaccgcccctgccagtacgcccgccgcagcaggtaccggggggtcagccggcccgggtcgatgtcatgggtgaccgcgtggtccgggagcagttgctcgcgggcgccggcggccttcatggcgctgatgaaggaggtgtcctcccctgactggaggttgcccccggtacggctgagggccaggtcgaaatccaacccgtgggcgtgcgcgaacgcggagtccacccccatgcacgcgccccagatcttgatgtttccctggtcacggtgccagccgaccaggtggaactggccggaggtgacgtaccacggcagacgcagcgcggggcgggccagccgggtgccgaccacgtgcgcgccgtcgcgcaggctcttgcggacggcgtcgacggcagcggcgtcgagccgcacgtcgtcgtcgacgaacatcagatggtggtgcggccagcgggcgagcatcgcgttgcgggaggccgacaggccattggtggcaccgaggatgcgcatggtgccgccggcggcccggacctcctcggcgacctcctccgcctcggccgtgacgggccggtccagcaggacgtagtactcgtcgccggagagctgggccatgttgtgcgcgaggtgtttcctgacgttctccacccggaacgcgcagatcgccaccaccatcgggtggtcggacggatcgcggctgaccacagaggcgttgttcggcatcgtccctcgacatgagcgttgtggggccggcggggagaggcggcccaccggatcgcgctccgcggcagcgtgccgcggccccggccgccccacggacaggtggcgcaccgcagcgcggcgggccgtccggtgagcggccgggggcggagctcaggccgcttcgtccttgctgacggtcggcggccaggtgcccgccgcgaggatgcccatcgcgtacgccttcgcgatcagggccggccggttgggcactcgcaggttctgcaacagcttgctgacgtggtactcgacgccctgacggctgaggtagaccttgttggcgatatgcaccgtccgttcgcctgcggcgatgctttcgatgatgcgcgcgtccagatcggacagtgagaacttgagattcacaacgcccccttgattgtggatctgttggctcgtacgcggccagacgtcatcgcccggacacccccctgaggtgccggtggacgagtggtcgcttccgctggaagaccgtcagcggcggaaggccgggtgcccgccactcgtcgtcctgcgcttgcggagctgtctcagtgtgcggcgatgcccccggcacgtagcccgcctgacgggcctgtcggcttgggctccaacttcggcaacccatcggttcgcgctgcacagaaccagcggaggaacattgagtttcgaagcccttcgctactgtcgatcgacatcactggcgaaatgaaaccgaccggattcgagccgatagttacggaaagtgacaatcggctggccctgtcgctcgcgctgaactcaccaatacgccaaaagcgtagccggcccactgcggagcgtccaccccccgaggatatcgccaggcttccatgcagaactggcaggatctttcatctcagccgcacctggcgacaaaacccctgctcaagaccatgagtaagcaggcgcgggaaatccatgcagtgacatgtgtcactttagacaacccagctccagccaggcccaccaccctgacaaaaggggcggaatcgcgaccagagcgacaccagcacattcctaggggattccttagtctggcgagcgtcgatcccccacccgtcaatcaattgcccgaacaaattgcccacccgtcaagatcaaccactccgcaccgtgagcaggccgaccgtccggcaatgcgaacgacgacgtccaccccgtcccggtagcctcaccgccgctgggggggcacgggcccggacaccgtccggcgtcgtgatcagcgggtcgctcgccggctgtcgccccgcgcggggaccggcatcgcgcgcggggccggcacgaagatctccggcgacctgtcagccctgcaagcggaccggcatcgcgcgcggggccggaaccacccgacggttcagcgccgggaccgatcgggaagccgactcgcggcctcgtcccagagcccgcccaccgcatcccgcagcgatcgtcggggccgccacccgagcaggtcacgcgcgggccccgggtcgacgcgggcccagtcgacgacctccaccgagccgggccgatccggcaactccaccacctcggtcggcaccccgctcacctcgatcaacatctccacgagggagcggaccggaacggcctccccccgccccacgccgatcacccgcccggtgacggactcccgcgtggccgacaccaccgcctcggcgacgtcccgcacgtcgacgtagtcccggtgggcgcgcaacggagacaactccaccctggccgaccggtcgcggcccgccgcgtcgaccaggcgaacgacgacccgccccaacaggctgtcgggtggcacgcccggacccaccacgttcgcgagccgcagcaccgtcgcgtccaccgagccggcccgcgtcgccgcgagcacggcctgggtggcggccagcttcgccctgccgtacatgctctccggctgggtgggcaccgtggcaccggcgggagccccgggtggctcctggacgcgttccaggaccgagccgaggtgcaccagcctgggccggcaacgggtgcgctccagcgccgcggtgacactccacgtcgggatcgtgcagctcgacggcagctcggcgtccgtcaggttccacttgccgccggtggcgttgaccaccgcgtcgggctgctcggcgtcgaacacggcggccagcgcggcgggctccagggtggcgacgtccagcgcccgggcccggtacggcagccccgccgacgggacgcggcgggccaacacgaggacgtcgtcgccccgggcggcaagcgcggcgctcacgtgacgcccgacgaagcccgtaccaccgacgaccacgacacgccgcgcgcccatccgtacctcctggggatcagtctcgtgcgccggcggcgtccaggcgaccgcccggcccctgacaggtcacgggggcgcgcaacaccctggcccggtcgcgaacctcgtccagcagccgggcccgggcgcggatcgccgtcacctcctccgccggctgaccggcggtgacggcgcggacgaactctcgcatcgtgttgacgaactggtcctcggccgggaaggtcagctcccgcgtctcgtcctgccgctccacccgcaccaccgggtgccaggccggcggtggggtgtacgcccggtcgacgacgatccggccggcgcttccccagagctggtactcgcaccggtaggagtgctcgaaaccgaaggcgatctgtgcggtccgcccgtccggcgtacacaacagcgcggcacccgaaacgtccacgccgcgatcggggtcctcccggagggtggccgccaccacctccggctcctccggcaggaagaaccgggccgcgcccaacgggtagacgcccagatccagcagcgctccgccacccagctcgggtcggtaacggatgtcgcccgcaggcagcggcggaaacccgaagacgccggagaccatccgcagctcgccgatctcgccggccgcgaccatccggcgcacgaagtggtgcaccccatgtcggaggaaggtgaggttgtccatcaacacgagcccacgcgaccgggcctgggtcagcaccgccgcggtgtcgaccagccgggtggtcagcggcttctccaccagcacgtgtttgcccgcggccagggcgcgttcgatccaggtgtggtgcagcccggtcggcagcggaatgtagacggcatcgatgtccgggcggtcgagaacggactggtagccctcggcggcggcgcacccgaactccgcggcgaaggcgcgcgccttggccagttcccgcgccgcgaccaccacgagctccgcctccgggacccgcctgatcgccggcagggcacggcggcgcgcgatgtcggcgcagccgagaaccccgatgcggaccgtcatctccgccatcgggtcaccacaggctgcgcaggcaggccagcaagctgcgggcctcgatgttgaggtagtagccgtgccggagcagggcctccagctggcgcaccgtcacccagcagaactcgtccggcacctcggtcgggaagtcgtcgccggcgtcgaccaggaggtaacggttctccgaccggtagaatcgcccgccctcctcggtgagcacggtgtcgtagaggacacgctcgggggcggcttccagcacctcggccaggaacagtggtcgggggccgggctggttgtccgggatgcactgcaccgttgggcccatctccatcgcgtcgagcagccccgcctggtagcgcgcgtgcaccagcaggtgcgccactccgtcgatttccttgaccaggaaggcgaccacgccccggtgccgcggatacaacagcggctgactccacccggtcacctcgcggttgtcgatgcgcaccgtgacgccgaccacggagaagtgccggccgtcgtcccgcgcgatcccgtccgcggtgtgccgccagtccggcagccctcgtagcggcacccgccgcacggtcatctcgtgccggcccttggccccggtgaaccagctcaacaccgacaccaggtcgtggcggccgggggcgcccgccgccgagcgcacgatcgccgccaccgccggcgacgacggcgcctcggtctcctgggccgcggcgtagaaggccgagggcagacatgacagcaccgtacgcgtgtccatgttgaccaggccgtccacccgcagcagcgcgagcagttcgcgcagcgggagccaccggtggtagtcgccggccggcacgtcctcgtcgacctggaccaccatgttccggttgcgcttgcgcaggaaccaggagccctgctccgactgcaggacgtcaaccagcacccgaccggcccccgggcgggtgaagtagtcgaggtacttcgtgccgccgccacggtgcacccgggtgtagttgctccgggtggcctgcaccgtcggcgagagctgcatgacgttgatgttgccgggctccaccttggcctggagcaggcagtacggtgtcccgtcgacgaccttgacgagcatgccgaggatgccgatctccggctggttgatgatcggctggtgccattcgcgcaccgcgccgtaggtggtctggacgtgcagcccctcgatcacgaagaaccggccgctctcgtgcccgaggttgccggtcaccgggtcgaacgcccacccgggcagccggtccagcggcacgcggtccacccggcagtaggtcgaccgggtccgctcggcgaaccaggagaggaagtccggccggaccccctcggcgtgcaacgccgaccacgagccgccgtcgaccgggccgggccggtgcgggcccgcgtcccgggtcagcaacggcccgtcggcgcggaccttcgggtcgggcgacgaatcgctcaccacagctcggccagttcggcggaaaaggcgtgggaagacccgtccgtgtccgccaacaggcgcagatcgctgtcgaccatcatggcgaccatctcctcgaaggagacggagggtttccagccgagccgctggcgggccttcgtcggatccgcgcagagcagctcgacctcggcgggccggatgagcgactcgtccaccaccacgtggtcccgccagttgaggcccacgtgggcgaaggccgcctcgaccagctcgcggacgctgtgcgtgacccccgtgccgaggacgtagtcctccggctcgtcctgggccagcatcaggaccatgccccgcacgtagtcgcccgcgaagccccagtcccgctcggccgagaggttgcccaggcgaagcgagctgcgaatgcccagcttcaccgccgccacgcccagcgacaccttgcgggtgacgaactcgggaccacgcaccggtgattcgtggttgaacagaatgccggagacggcatacatgccgtacgactcacggtagttctgcaccatgtaatgcccgaacgccttggccgcgccgtacgggctacgcggatggaacggggtcagctcattctggacgggctcccgcaccttgccgaacatctccgacgaagacgcctgataaaagcgcggctgaccggctgcgggactgcgggaatccgacaggccccccacgatccgcaaggcttcgagcatgcggagcacacccatgccggtgacctccgccgtcgtggtggactgccgccacgacaccggcacgtacgacagcgcgccgaggttgtagacctcgtccggcgccgcgcgttcgatcgccgccaccaggctcgtctgatccagaaggtcgccgctgatcagcttgaccgctggatcaggttgccgaaggctgcggaccgagggcgcggtctgcccgcgcaccaatccaaatacctcgtatccggactgaagcaggtgctccgcgagatacgtgccgtcctggccggtaattccagtgatcagcgcccgccgtgtcagggtagtctccagccgtgaagccacctggccgaggcgtgacctcgcgccgatggcggaccaaagatccgcccgttcgaaatggggtcggatctcccgctaccgcgctcacggtacgcgaatctccaagcggattcagcgacccggaaagcaatatagggaggttactagtagtactttccggcgggccggcagcgacgcccggcccggaccggcaggatcgccccgttcggccggcggacccatcccggacaccttccaccgaagctcttcgggatcgtcgcccgccgatgcgaactgcttgactccaccgttttgtccccctaacgtcggcgaggctgccagccggcccgcgagccgggccgggttcacgaaggcgccaacttccggtgagagagcagggctcatgtcgcagagccggcccgcggccgcagcacccccagcccgcctgccacgtcgccgcgccatggtcgcgttggtcgcggtgatgatcccgatggtgctggccaccctcgacaacaccatcatcggcaccgcactgcccaccgtggtcggcgagttgggcggcctcagcacgctctcctgggtgatcacctcgtacacgctggccacggccgcctccacgccggtctggggcaagctcgccgacatgtacggcggcaaggtggtcttcgtggccacgctggtcgtgttcctggccgggtcgctgctgtccggcatggcgcagagcatcacccagctgaccgtcttccgggccgtgcacgggctcggcgcgggcggcctgatggtctgcgcgttcgccatcatggtggaggttctcgccggccctgacctgcccaagtaccagggcatcatgtcggcgaccatgggcctgaccatggtggcgggcccgctcgtcggcggcctgatcaccgatgagctcggctggcgctggtgcttctacatcaacctgccgatcggggcggtcgcgctgctcatcgtggtgctgatgatgcacctgccgcgccgacacaccaaggcccggatcgattacgcgggtgctgccctgctcaccgtggtcagttcgtgcgtcgtgctggtgaccacctggggcggcatcacctacccctgggcgtctccgatgatcctggggctggtcgcgctcggggtgctgacctgcgcgctcttcgtggtggtcgagcgacgggtggccgagccgttggtgcccctggccatgttccgcagcctgaacttcaccctgagcaccctcatcgccttcctggtcggcttcgccctcatcgcggggctgaccttcctggccctgttccagcaggcggtgcagggtgcctccgcgtccgactccggcctgttgctgctgcccctgctgctgtccatggcggcggtcaacgtggtcgggggtcgcctgatgagcggcgggcgttcctaccggctgctgatgctcgccggtgcggcgctgatgaccctgagcctgctgctcttcgccctgatggacgtgggcaccagccggacggtcaccgcgatccccatggtcggcttcggcgcagggctggggctgctcatgcagaccagcctgatggtggcgctgagcagcgtggagatgaggaacctcggggtggccgcctccacgtccacgctcttccgcaccatcggtggggcggtgggggcgtcggcgacggtctcgctgttctccgtgcgggtgcagtcggcgctggccgatcggggggtcgccgacgtggctgacctcctcggccactccgcgcggctggacgccgccgggctggcccaactcccccgggccgtccgtgtccacttcatgcacgcggtggcctccggcacccggtgggccttcctgatgaccgtgctggcggggctgatctgcgtcgcggcggcgtggttcctgcgccgggtcaccccgttgacgtcggcaccggtggcacccgaaccggcgcgcgacgtcgccgcgcccgccgccagcagcgggcgcgcgccgaactactagcggatttcctagggttcctcgtcgacggtagagctgaattcaccggcgacctaacattcttttcgcgatccggaatccgtccattcccctgtctggcgatggtcgacgggccggcccgtgccgagcggacagacacagattctcggattggagctcgatgtccagcaagatcctagtcatcggtggaggtccggccggatccacggccgccgcgctgctcgcccgatcggggctgtcggtgacgctcctggaaaaggagacgttcccgcgataccacatcggcgagtcgatcgcgtcctcgtgccgcaccatcgtcgatttcgtgggcgctctcgacgaggtcgactcgcggggctacccgcagaagaacggggtcctgctgcgctggggcaacgaggactgggccatcgactgggccaagatcttcggtccgggcgtgcggtcctggcaggtcgaccgggacgacttcgaccacgtcctgctcaacaacgccggcaagcagggcgccaagatcatccagggcgcggctgtcaagcgggtgttgttcgacggtgagcgggccaccgccgccgagtggttcgaccccgagtcgggtgaggtccgcaccatcgatttcgactacgtggtcgacgcgtccggccgggccgggctgatcccgtcccagcacttcaagcaccggcgccccaccgagacgttcaagaacgtggccatctggggctactggcagggtggctcgctgctgccgaactctccctccggcgggatcaacgtcatctccgcgcccgacggctggtactgggtcattccgctgcgcggcgaccggtacagcatcggcttcgtctgccaccagagccgcttcctggagcggcgcaaggagcacgcctcgctggaggacatgctcgccgcactggtacaggagtccccgaccgtgcgcggcctgacggcgaacgggacgtaccagccgggcgtgcgggtggagcaggacttctcgtacatctccgacagcttctgcgggcccggctacttcgcggccggcgactccgcctgcttcctggacccactgctgtccaccggcgtgcacctcgccctctacagcggcatgctcgcctcggcgtccatcctggccaccatccacggtgacgtcaccgaggaggaggcgcgggcgttctacgagtccctctaccgcaacgcctaccagcgcctgttcaccctcgtcgccggcgtctaccagcagcaggccggcaagagggcatacttcggcctggccgacgcgctggtgcacgacagcggcgaacccgagtacgagaaggtagacggggcccgcgccttcgcccagctcgtcgccggcctcgccgacctggacgacgcggcggagggacggcacgacagcaccgcggcggcggcaccggcggagcaggacaactccgtccggcagctcttcctggccgccgaggaggcccgccggatggccgacgcgcgcacgccgagcgccccggtcagcgaggcgccgggcaagctcgacagccacgacctcttcgactcggcaaccggcctctacctggtcaccaccccgcgactggggatccgccgggccaagccggccgacacgcaggcggcggcagagcagtctgcctgaggttccacccctggtggcccccggcccggaccgcgccggtccgggggctgctcaaccctcccaccaacatccggcatccggtgccggcggctgagcaggggcagcgccaccgactccggcccgtcacatggacaaggtcacctctcccgtgctgaacagacgacagttgctcgccctcggcagcgtggccgccggaggcaccgtcatgtcacgctccctcagacgggacgcgcaggccgcccaggcggcaccggcgtcgcccgccaacccgcacgccgggcacgccgccccggtgcccagccgggtcagcacgaccacggtcgcggtcaccccgttcaccgagccgatgcccgtcccgccgcggctgaccccggtctcccgccgcgacggcatcgacgtctacgagatccccatccggccggcgcaggtgcagatcctgcccggcctgctcacgcccgcctacacctacgccggttccttcgtcggccccaccatccgggcccgcacgggccggcccgtgcggatcacctacaccaacgggctcgacacccacgccaacgtgcacctgcacggcgggcacgtgccggccaccagcgacggtcacccgatggacctgatcccgccgggcggctcgaaggtctacgactacccgaaccttcagcgcggcgcgacgctctggtaccacgaccacacccacgcctacgaggccgaccacgtctaccgcggactgcacggcttctatctgatcgacgacccggccgagcatcacctgcgcctgcccgccggcaagtacgacgtgccgatcatgctgcgcaacgcccagttcgacgactccggcgccctcgtcttcggccacccggacgaccgggtcaccatcctggcgaacggcaaggcccagccctacttcgaggtggccccgcgcaggtaccggttccgcctgctcaacgcggcgctgaagcacgtcttccggctcaacctgggcggcgaaccgctcacccgcatcgccacggacggcgggctgctgcccgcccccaccagtcacaccgagctggcgctctcctccggggagcgggtcgagattgtgatcgacttcgccgagcacgcaggcggcgggccggtctacctctacgacggggacaacccgatcctgcgcttcgacgtgtcgtcccgggcggtcaccgaccccagccgggtgccggtcaccctgcgcgcactgcccccgatgggcacgccgaccgtggagcgcaccgtgtcgatgagcttcgacatgtcggcccggcccccgatcgcgctcatggacggcaaaccgttcgaccctctccgggtggacgtacaggtcaagcggggcagcaccgagatctggaacgtggtcaacgcggataccgatccgttccccttcgaccatccgttccacctgcacctggtgacgttccgggtgctcggccgcgacggcgggccgcccgcgccggaggacgccgggctcaaggacaccgtctacgtctcgcccaaggggtctgtcaagatccaggtcaccttcgccacgccgtacctcgggcagtacgtctaccactgccactacctggagcactcgtcgctggggatgatggcccagctggaggttgtgccctgagggctcagccgtgcaggtcgacgatcgaggggtgggcgccgaacaggctgaccggccgcacgtcgcccaccccgaacccggcggcgcgggccaggtcggcctggtcggcgaactcgtgcagcagcagtaccgcccgcccgccgtcgaccgtcacccggcgcagctccgcgaagaggcggccggaatcaccggcgagcacgccccgcgcctgcacctgccggtcccagggcggattgctgaccacccggtccacccgaccggtccgcagcggcaatcgtccggcgtcggcgaccgcccaggtgacgcgggcccccgacgccgccgagttggcgacggccgcgccgaccgtctccgggtcgtggtccgagccgaacagcaccgcccccggtgccagcccggctgcctccacggggatcgtgccggtgccgcagcacggatcggccaccagcatcccggggcggatgccggccagccaggccagcgccgcggcgagcggcggatgcagggtccccggcgtggacgaccgcttgtaggcccgccggtgcagcggccggtcggccacccgtaccgccagcgtcgcctgggtgccctcgacggtgacccgcagcgacagcccgccctccggcggggcctcgccgccgcggcgggagtggtagcgcaacccgagcgcggccaccgcgtgccgccccacggcgtcctcgatgtcgtaccggttgtagttgcggcggccgaggaaggaggcggcgacgtccacggtcgccggccgcccgggcacgccgcaggcggcgcgggccggcagcaccgccggcagcgccgccgcccgggccagccgggtgaaggccgccaggtccgccttggtgtggccgacgccgtcggcgacggcgacgagcaggaacaggtcgtcgacggtacgcagatccagcaggcgcggctccgcgctggcggcggagaaccacacctcgcggtgccggcggtgctcgacccggccgaggccccgctcctcgatctcctgggcggccacctcctccagccctcgcagggtccgtgccatgaagcgcaccgtcaccgtccgccgatcctctccccgccgggtcgtcccgccgccgtgccggcggcgtccgcgagcctacccaccgcacccgccgccgggacgcagccgacgccgaccggacccgccgacgggggagccgacgccgaccggacccgccaagactaggtgaacctctataggaattcgcgtgcccccttcatagggtccgaaaggggtaatggaaccgtccggcaccggacggctcgttttcttcccccaattccgtccgtccgacctgagccgtcgcagggaaggcgaggccgagcagtcgagcagttgatcggtcgatgccgcacgggcccgtgcgccgaaatcgtggagattgcgcagtgcgtacaccggatctgttcatcggcgccgtcggcgccttcgtcccgccgacggtgagcgtcgagtgggcgatcgaccgcggtctttactcccgcgagcaggtggagctgcacgagctggcgggcacggccatcgccggcgacctgcccgcgccggagatggcgctgcgcgccgcccaacaggcggtcaagcgctggggcggctcgccgacggagttcgacctgctgctctacgccagcacctggcaccaggggcccgacggctggccgccgcactcctatctccagcggcacctggtcggcggcgacctgctggcgttggagatccggcagggctgcaacgggatgttcagcgcgttcgagctggccgccagccacctccaggcggtacccgagcgcaccagcgccctgctggtcgccgccgacaactacggcaccccgatggtcgaccgctggcggatgggccccggcttcatcggtggcgatgccggcagcgccctcatcctcaccaagcgacccggcttcgcgcggctccgctcggtctgcaccaagtcggtcccggaggccgagcggctgcaccggggcgacgagccgctgttccccccgagcgtcctgaccggccgggagctgaacttcaccgcccggatcgaccaacagttcgccgcccgcagccccgcctcgatcgccatggcggacgtcggcgaccacatcgaggaggtcgtggggcgcgccctcgccgaggcggagatcgaggtcggcgacctcgccagggtcgccttcatgaacttttcccgggagatcatggagcagcgctgcctggccaactggggcctgcccatgagccggtccaccttcgacttcggtcgccggatcgggcactgcggggcgagcgaccccttgctggccctggaacacctggccaggacggggggcctcggccccggcgatcacctgctgaccctcggcaccgcgccgggcgtggtggtgtcgtgcgcgatcgtccaggtgatcgagtcgccgacgtggcgggagtgacccgctggacacctgcggcggcccgcccagcccagcaaaccgacagcaggggatgattgtggaagcagagaaggaccggttgcgtccggtggcgtccgaggcggtcgccgtggtggggatcggctgccggttcccgggcgacgtcaactcgcccgacgagttctgggacctgctcaccgggggtcgcaacaccaccgggacggtgcccgaggagcgctggagcgcgtaccgcgacctgggtccggcgttcgagtccgcgctccggtcggccacccgggcgggcaacttcctggccgacatctccggcttcgacgcggacttcttcggcatctccccgcgcgaggccgagctgatggacccgcagcagcggctcatgctggaggtgacctggcaggcgctggaggacgccgggatcccgccccgcaccctggccggcaccgacgtcggcgtcttcgccggcgtgtgcacctacgactacggcggccaccagttggaggacctgccgcacatcgacgcctggacgggcatcggcgccgccacctgcgccgtcgccaaccgggtctcccacgtgctcgacctgcgcgggccgagcctgtcgatcgacaccgcctgctcggcgtcgctggtcgcgttgcacctcgccgcgcagagcctgcggctgggcgagagcacgctggccctcgccggcggggtcaacctgatcgtcacgcccgggcagtcgatcaccctcggctcggccggtgccctggcacccgacgggcgcagcaagtccttcgacgccaccgccgacggctacggtcgtggcgaggggtgcggcgtcctcgtgctcaagctgctctccgacgcccagcgggacggggaccgggtgctggccgtgctgcggggcagcgccgtcaaccaggacggccggaccaacgggatcatggcaccgtgcggccaggcccaggagcacgtgatggtccgcgccctgcgctcggccggcatcgaggccggcagcgtcgactacatcgaggcgcacggcaccggcaccccgctcggtgacccgatggaggccgcggcgatcggctcggtctacgggcaggaccgcccggacgacgagccctgcctgatcggttcggtcaagtccaacatcggccacctggagggcgcggccggcgtcgcaggcgtcatcaaggcggtcctggcgctgaaccgggccgaggtgcccgccaccctgctggtcaccgaggtcaacccggacatcgagtggaagcggctgcggctgcgcctggtcacccgcaaccagccctggccggaccggccggggccgcgccgcgccggagtctccggcttcggctacggcggcaccgtggcgcacgtggtgctggaacaggccccgccggtcgccgccgagccggccccggcgctgaccggcgagacgctgttcccgatctccgccggctccgcgcactcccttcgcgagcgggcccgcgccctggccgggatcgtcccggatgtcgacctcgccgcgctcgggcacaccctggctcggcggcgttcgcacctgacccaccgggcggtggcggtggccgccggccgggacgacctggtcgcggcgttcgcggcgctcgccgacgacaggccgcacgaccgggtgcgtaccggaagcccggtggcggagccgccccgcacggtgtgggtgttctccgggcacgggtcgcagtggacgggcatggggcgggaactgctggccacggagccggccttcgcggacgcgatcgaccgcatcgagcagatcttcctcgacgagatcggtttctcaccccgccaggcgatcctcgacggcgactacgaggccgtcgaccggacccagacaatgatcttcgcgatgcagctcggcctggccgagatgtggcgagcgaggggagtcgagccggacgcggtgatcggccactcggtcggagagatcgccgcggcggtgaccgccggcatcctgaccgtggccgacggcgcacggctgatctgccgtcgttccctgctgctgcgcgaggtcgccggccagggcgcgatggccctggtgacgctgcccttcgaggaggtcgcggccaggctggccggccgcgtcgacgtggtcgccgcgatcgcctcctccccctcgtcgaccgtggtctccggcgacccggccgcgctggacgcgctggtcgccgagtggaccgaggagggcctgggcgtacgccgggtcgcctccgacgtggccttccacagcccgcacatggatccgctgctcgaccggctgcgcgccgccgtcgacttcaccgcccgcgcaccccgggtgccgatctacagcacggcgctggccgacccgcgggccccgatcaccgccgacggcgagtactgggccgcgaatctgcgcaacccggtccggctcgccgcagcggtggccgccgccgtctccgacggacaccgggccttcatcgaggtctccccgcacccggtggtgacccactcgatccacgagacgctggccggaagcctcgacgacgaggtcttcgtcggcggcaccctgcgccgcgacaccccggaggcgcaggccttcctgtccagcctgggggccgcgcactgccacggggtcgcggtcgactggggccgggtgcatccgtccgggccgctggtcaccctgcccggctacccctggcggcaccggagtcactggcactggccgacgccggccgccgccacgggccggggccacgaccccgcgtcgcacaccctgctcggcgcggtcgacaacgtggcgggcagcgacgtgcgggtgtggcgcaccgcactcgacgacgccagccgcccgtacccgggcagccacgccctcaacggcgtggagatcgttccggcggccgtgctggtggagaccctcatggctgccgccgggcggggcgacggccggccgctgctgaccggcttgtcgatgcggtacccgctgatgaccgccgggctgcacgaggtccaggtggtgcgggacggtgccgaggtgcggctggcgtcccgttccgtcgacgcggaggccgacccgagccgggactggctgatccacaccgacgccacggtggccgacgccgacgccacggtgctcgccgcgcgggcgttggccgaccccgacgaccaccggatggaaccgggcgacccgggctccatccaccgccggctcgccgaggtcggggtgccgtcgacgggattcgactggtcggtggaggagctgctctccgggtacggcgtgctccgcgcgcgggtgcgctcggccgactcgtccacctgggcgccggtgctggacgccgtcatgtcggtcgcccccgccgtcttccccggcgtgccgcagctacgcatggtggtgtacgtcgacgaggtgctgctcaccggcgagccaccggaggtgacgctgatcgaggtcgccctcgacccagaccggcccgacacggcgaacgcgctggtcgcggatgctcagggccgggtcgtggccagccttcccgggctgcgctacccggtgatcgaccagccggtcgccccggcgcaggacagttccggcgaggtggaggaggcggtctccttcgccggcctgtccgacgaggaactgcacgagcgggtgttcgacgaggtgcgccggcagatcgccggggagatgcgactcgacgccgacgacctgcatccccgccggccgctggccgagcagggcctcgactcggtgatgacggtggtgatccggcgacgcctggagaagcgcaccgggcggagcctctccccgaccgtcttctggcagcggcccaccgtcgccgccatcgccgaccacctggtggagctgttgagcaccccgcaggagtgaggatccgcgacgacagggagggcccgtgcgttccgcacgggccctccctgctgtcgacggatcttcaggtggcggggtcagcccggccgctggtccaccgcaggggtggcggcccactccaggtggcggctctcccgcagggtctcctcggcgttctgttcgacccgccgcatggcgacgcgcagcatcggcggcgccatgaccgaggtgacgaccgcgaccagcaccacgatggtgtatgaggcggtgttcagcacgcccaggcgcagcccgaccatcgcgatgatgatctccacggcaccgcgcgcgttgagcccggcgccgagggcgacgccctcccagtggctctgccgggccagccgtgcacccaggtacgcgccggtgtacttgccgagcacggcgagcgccaggatcaccgccccggcggcgagcacctccgggtcggcgagggcacgcagatcgacccggagccccgcgctggccaggaagatcggggcgagcacggacagcaccaccgtgcgcagcggtgccagccgggccggctccccgttgccgggaaggccgatcaggacacccgccaccagcgcgccgaagatcgcctccaggcccagcgcgtgcgcccccgccgcgaaggccagcacgatcaccacggcgacggcgctggcggccccgccgtcgggctgggcgttcgcccagcgcatggcgcgccgggtcaccggccggccgaccaggacggccaccgcgaggtaggccacgaggtaaagcagggcggtcaccacctgcccggcggtgagggtgctcaccgccaccgacgagatgagcgacagcaggaaccaggccgcagcgtcctccagcgacgccgcagccaggatgatctgccccacgtcgcggtgcagcaggcgcatgtcggtgagcgtcttcgcgatcaccggcacggcgctgaccgccatcgccacgccgacgaacagcgcgaagacagtccgctcctgcccggccgcgagaagcgccgccggggccagcaggccggcggcgatgcccaggccgaggggcaccgcgaggccgccgacggccaccgcgccgatcgtgccggcccgccgccggaccagccgcaggtccaggtgcagaccggccacggcgaccagcagtacgacgccgaactgaccgatggcgtcgagcaggtggacctggtcggggtcggcgggcagcagccaccgtccgatgtcgggtgccagggcccccagcaccgaggggccgagcagcaccccggtcagcagctcaccgaccaccgccggcaggccgaagcgttgcgccacccgtcccaggacgacggcgagcagcagcagcaggcccacctggagcaggaacagcagtagctggtgggagcccagcgggggcaccggcgcggccacgatcacggtcgttgttcctttcgtctcgacgcccggccgggcccgccggtggtcaggccgcgatctcgggcggcaggtccaccgggtcggccgagttcatgaaggtccgcagggcccgcaggtcggcggcgggcttctcccagcccagcccggcgcaccaatcgatgagggaggtcagctccccggtggcccgaaccttgtcctcctcgggcaggctgagcaccgacatctcggccggccactgcaccacgttggccaggtccacgtcgagcccctcggcccgggcgaactccagcaggtcgcgcagcccccagacgttgtcccgctggggtgccacctggagccagaggttgacctccgagcgggcccggcggacgttcgcgatgaaggtctcccacttcgcgccctgccggatccgctcgaacacctcgccgtagccgtcgcaggaggcgccgatgccgatgctcttgaagtgccggaaccggtcgaagaccgactccggcaacacggtgaggttggagttgtagacgacgtcgacgttgccggcgttacccgtctccaccagcaggtcgagcagggcgaagtggcccggctgcatgaacggctccccaccggcgaagtacagccgccggatgaggtgggcgttctcgcgcagggtctgccacagctcgtcgtcgtcccggtaggcgtcgatgaccgcggacgaccaggccggccgcttcttggcgccccagcccgagctgaccgggtacgcgcacatcacgcaccgcaggttgcaggtgttgccgaaccggatgtcgaggaagaacgggaagtcctcgacggtgccgtcgggcgcggtgcgggcggccagccggtcggggtcggcgatgtcccggaaccgctggttgatctcctgccggtacgacagcgcgccgtggtcctcgcggtggtagcagtaggagcaggcgtcgacccgctccccggccagcatcgccagccgggtccggcgcatgttggggctgttgaaggcgtccgccaggcccatcacccggccggggttgtccgccgcgtagcgggaccgcggcgagcagccgacggcgtcgtcgttgagcaggaactccggctcctcctcctgctcgtacagcttgttgtggtacatcgagtcgtccacgcagcaccgcccgtagacaccgtcgatggacgcgcagagatggatccagggcagcacgcacatggtccgggaccgggcttccgggtcagtcatgaaagttgatcacctcggtggtgggggcggtgtcatcccggtcggccgaccgtctcgacccggggcagcggaaagatcaaccgggtgccgctggccagcatctccgcctcccgggcgacgatctcgtcccggaagtgccagggcaggaccaggtagtagtccgggcgggccgcccgcgactcctgctcgctgatgatttcgatgtccgtgccgagggtgcgcgcgcccaccttgtccggattgcgctccgcggcgtaccggatgagctcgcggtctatgccgcagaactgcaggagggtgttgcccttcgtcgacgcgccgtagacgtgcaccgtgcggccctggccccgcagctcgcgcagcagggcgctcacctcgtcacggtgctggcgcacctgctcggcgaagcgctggtacggggcgtcgccgtccagccccagcgccagctcccggtcggcgagtgccttgaccgaaccgtcggcccggccgcccacctcaccggcccgggtgaccacgcagcagatcgagccgccgttcaccccgttgaggctggcacggacgatctccaggcccgccgcgcccagaatgcggctcagcgtggccagcgagtagtaggacaggtgctcgtggcagatgctgtcgtagccggcgatctccagcatcgccggcaggtaggcgacctcgaccacccagaccccgcccggggcgagcagcgcctcgacctgacgggcgaactccaccgggtcctcgacgtcgtagaacatcgcgatcgaggtgaccaggtcgaagctgcccgcgtgcgggaccagctcggggctggggaagaagtcgcggatcagattgaagtcgtcgggcgcgtcgtcggcggcgctggaggggtcgatgccccaccgctgcgcgtcggtcaggttgcccagcagggtgccgtcgttgcagccgatgtcgagcaccttgccgggccgctcccccaacacctcgaccgccgcgtccacgacgtcggcgagatgccggcgcatcgtgtcgttgatccgcgagcggtaccagtaggtgtcgtagagcagcccacccggcagggtgtgccgcaactgcaccaggccgcacgggtcaccgccgtcgcgttccgcgcaccgggtcagctccagggggaagcgcaccctgggcgggtccgacacgccgggcttcacgaagctgccctgtaggtactgggcaccgaggtcgaggaccgtacgcagggtcccgccacacacccggcaggtggtccgctcgaccacctccgacgccaactcctcgccggccgccgccaactggctcacgtcaggtcctcctcgtctcgtgccggtgtgcgggaccaggcgccccgtcgtgcggtttgctggcgaccagcaggatgtccagatagaagggctggtcggggccctcgctgcggccgagatgccggaacgcccggtcgaggtactcgtcgagcgcgcggggccgcagccggtccaccagccacagggcgcgcagggccagacccaccgggccgccggacggccagccgtgctcgcggccgtaccagcgcagcagcagcaacaggccgcgcggcccgcaggtcagcttgacggtgcggtcgacggtgaagccggcccactcggcctggcgggccagcccgtcggcggtccaccgccacaggtcctggccgccgtgctcctcccacaccccgtgggtggagagcaccagccggccgcccgggcgcagcagccggtacgcctcccgcaggtacgcgtccgcgtccgagacgtgttcgagcacctgggtggagagcaccccgtcgaacgtcccgtccggcaccgggcagcgcccgtcccggtcgagggcgtggtcggccggcagggactcaccgcccgggatgtcggcggtctgcaactcggcggagcggaacaggccccggtatggcgaggtgcccgcgccgtagtcgagccagactcccgtggcgtcccggaccgcctccgccagcgcgtcgcgcaggtccaggaagtgggcgtatgcccagtccccgggccggggctcgatccgctcccggaaccgttcggccatcacctcgtccagcgacgggccggtgggggcggtgccggcaccggtcagcaggggaccaagcccgggtacgcgccgcagcagggtcaccaacgccagtactcctcgtgcgggtaccgcatggtggtcggctccggcaggccctcccagcgccgcagcgacgcggcgggccggtactcgaagggctgctcgccggcgtgctccggtgccgcccgccgctgcgccaggcaggagagcagcacctgctgcttgagcccgatgtactccggcacgtgcgggccgaggtccagctcgacctcggcgggccggtactcgaagtagatgacccggcgccgcttgccggtcaccgccggcgcggcgtgcagcatcaggatgttgtgcagcatcacgtcgcccgggttcatcaccgccggcaccgccccggtggtgtcccactcggtggcgttcatccgggtggtggtctcgttcgcccggtcggtgtcccagtagttcgactgcgggatgcaccagacgcagttgtcctccggggccgggtcaaggtagatgccgacgtcgatcacccggcccgcgccggtgatgccgaccgcgttctccgggtagaggccgccgtcgcggtgccagggcagccggggcgcccccgcctcggtcttgaagaccatgctgtcccaggtggggatgaggttggggccgaccaggtcctccatcgcccgcagcagcagggggtggccggcgagccgggcgaccaccggggacttgtcgaccacgtactcgatccgcaccggcgccgcgtccggctcgtgcggttccagcgtccagatggtgtcggtcatcgtccgggtgcgccaggcttcgtcgatcagctcgtcggccgccgcctgcacggaccgcagctcgtcggggtccagcagcccgcgcaggatcagcgcgccctgccggcggaaggcggtcaggtgctccggaagcagcccggtctcgtggatgtggcactcggggacggcctgctcggtgcggacgtccacagtcgcgctcatggttcggttcccttctgccaggcggacggttcgtgctgcccggagccgccggccgggcccgggctcggtcggtcggcgacgaagtaccagtgctcccgcagcgcgtcggcgaaccccgcccggtccagcgccggctgcccggcgcggcgcccgggcagggtacgcagctcgtaacccagctcggtcacgagcagcgcccacaggtcggcgctggtggtgccgtactcccgcatggcgtggtcgccgccgtgctcgaagacgatcaccggccgccagcggcggagcagctccacggcaccgcgcagggcgagcacctcgccgccctcggtgtccaccttgaccaggtcgatccggcggtcaccggggagcacgtcgtccaggcggacggtgtcgaccgtcagctcccgcagggtctcgtccgggcggtcgtagggacgccggcgcagcccgctgtagccggggttggagaccacgtggacgaagctgtcccggccggtgcgctcggcggcggcggcggccaccaccgtcacgccggggaagtcccggcgcagcccctcggcgtacgacggcagcgcctcgacggccacgtgccggccacggggggcgacccgcagcaggtgacgcaggatgtcgccggcgccggccccgatgtccacggtgttggcgtccggttcgcagatctgctcgatcagcgccacggtgagctggtcgtaccagtcgttcatcgacagcgcgccggcctcgtcggtcgcggaaagctcagtggacatcgtcacgctcctcggtccggcacgccggtccggccccggagccgaccgccggggcggtacggaccaggagttccagctcccgcagctcgatctcggacagctccaggccggcggcgcggacgttctcctcgacgactccgggcgactgagcgccgaacaccggcaccaccccggccgggtggtgcagcgcccaggccagtgccacctgcgcgacggtgtgcccacgctcggcggcgaaggcggcgaggccgtcgaccacgtcgagcagttgggcgtagtcctcaccccggaaggcgtgcgagtaggcccgccagtcctcgggggcgaatgcctggtcgcggtgcagcgcgccggtgagcagcccgtgggcgagcgcggagccgcccagcaccccgacgccggcctcctggcagcggggcagcacctccttctcggcaccacggtcgagcaggttgaacggcacctggacgacgtccagcagcccggtcggcaccagctcggccaggtcgcccgccgtcacgttggcgaagccgacatggcgggccaggccctcgcgcacgaaccccgccagcacctcggcggtctccgcgagcgggacggtcgggtcgggccagtgcacggagtacacgtcgacgtggtccgtgccgagctgacgcaggctggccagcagctcgtcccggaggaacgcggggtcgctgttacgcaccgtccgtccgggcgggtcgagcttgtgccgtcgcacgccgggccgggtctccagcccgccggccgtggcgatcacgatctcgtcccggtgcgcgggcaacaggtcggccagcccgcgggcaagggccgcctcggcggccccgccgccgtacgcccgggaggtgtcgaaaagggtgacgcccaggtcgaaggcccggcggacggcctgcacgcctggttcgatccgccggccccactggccgccgagcgcccaggtgcccaggccgagcgccgagaccagcggcccccgctcaccgatgcagcgctgccgcacggcgtcctcccgcccggtgccccacccacgcccgtcggccggccgtcacgccgccggctccccgtcgctgcgcagcgtcaggaacaccacgccgtcgtgattgatcatcttgtcggtgaccggcgtcagcccggcctcggcggcgatgccggtcatcaactccacgccgtgccagttcaggaaccccttgaactccacggggttcgcgtcgcggtaccgctcggcgtaggtgtggaagaagccgcgcgtgttgtcgccgaggtccaggaagttgaagcagaacagcccgccgggccgcaggatccgccggatctgacggaagtagaggaagacctcgaagacgttgaggtggatgaacacgttcagggagaacccggcgtcgaacgcggcggtcggcagcttctccaggaagtcgttctcgatgtggtggtaggagacgttctcccggccctcgcaggtggcgcgcgccttgtcgaggaaggatcggctgacgtcggcgcagagcacggcgcgcacccggtcggcgagcccggccgccatgatgccctcgccgctgccgatctcgaagatctccgattccgggccgagcccgagctgctcgacgaccagggcgaccttgtcgacacggtcctggaggtactcctcgcgcggctggtagccggcgagctgcatctgcatctcctccggcgtgttccactcccagacgtagttgaggtcgccggtgctccggagcggacagccccggggggcgtcctgcggcggcggcgtcgcctgcttcgcgtcgttcatcggacctcactcgcggtcttgtcgggctctgcggggacaactgggcgggcggctgcggaaaactgggcgggcggtgtcacggacgccgggcgaactcggcgacgtcctcggggctcagcgcgccggtgtcggccagccgggccaggagttcggccacctggacggcggtcggcccggtggtgacggactcccgcatccgctgcgccgccacccggaatcggtggtcgtagaggacggagccgagggcctcgtcgacctcctcgcgggacgccttcaggccgggcagcgtcttcgtcgcgccctgcgggtcgagccgccgcccgtagatcagggcgtcgtagttgagcgccagcgacaactgcggcacgcccatggcgagcccgttcatgtagcagttggcgctgccgtggtgcaccagcaagtcgcagtcggggaggatgagctccagcgggcagttgctgagcacccgcacgttcggcggcagcgcgcccagcccctccacctcggaggaggcggcggtgatcacgacctccacgccccgctgggcggcggcgtcgacggcgtgccgcagcgccggcacctgcgcgccgaacacgcccgtggcggagttgccccacaccacgcagacccgcttgccccggcgcggaccgagcagccaggggtccacgtcctgggagccgttgtagggctggtagcggatcgggatccgcagcgcgtcgcccatcggcgggatcgccacgtcgggcgacgggtcgatggcgtaccggatctggtgccggctccactcgacgccgtacttgcggaactcggtcaccgggtcgccggagaccaggtcgagcccgggctcggtctcgatggtgccgatgaacccgggcgagaagtagacgctggggatgtggtgcagctcggcgaccagcgcgccctccacggccatgatgtcgtggaccaccaggtcgggccggtagtgggcggcgtagtcgaccgcgttgtcgtagctgcgctggaccgcggtgaccgtgcgcttccagtagtcggcgagcaggtcggtgtcgaagtcggcgagcgagtccatcggccggcccgtgaaggggttcaacggcagcggttgctccaccatgtgctgcggggtgtagagggcctggacgtagaagcccagccgggcgctctccatcatgtcgggtccgtcgagcaccgagacgggcatcatgcccgccgcggccacgccccggacctgggacggcgaacaggcgaccttgacgtcgtggccggccgcccgcagcgcccaggccagcggcaccatgcacatgtagtgcccggcccagttggacacggtgaacagaaccttcatcgcagcctctctgtggcctgccgaggggaggttgggggtcgcggccggacggtcaggaggtcaggaccggcaactcccgcgcgggatcggcgaactcgatcacgatggtgcgccgccactggtcggaggggttcggcccggagccgtgcaccagccgtacgtcgtggacgatgaagtccccctcctgcgaggggaccggcacccgcggcccggcgtcgcgcacggccgtgacgtcggcgtcgtcgggcagcaggtgggagccgggcacgccctccagacagccgttctccggcccggcggtgtccaggcagatgctgatgttgcagaccgcgtgcggggggacgttgacccggtcccggtgccacggcacgccggccgcccgcagtggctccttgagcaccaacgcgaaggcggtgggcacgaccggggtgccgaggacgtcggcggccaccgcggcgatctccggccggtgcagcaactcgccctgcggccagtcctgcttttcgaggttgtggatccggtacagcaccggctccgcgccctcgacctcgtagttccagtagtcggcgttggcccgcgccggaccggcgaaccggtcgatcaggcttaccgcgccggccttgagctgggccagcacctcggggtcgagcaccggcccgacgtgcgcgatcccgtcgctgcggaaccggctggccacggcctcgcgctcccgcgacatggtggtcatcggaggctcaccccttcggtcggtcggcgcgtgccggtgcggcggccgacggcgatgatgtcgcacacctccggcgaccggcgctcgtgcagcacctccacctcggcgaagccggcgttgtgcagggcggcgaacagggactcccggtcgagccagcgcacgtcgacgctgagcccccgggcctgcggctcggggtgctcctcgcggacctgcttgaccgtgtagccgtcgatcggttgcaggtcgcccacgcctccccagtagtgggtggagaggtagattcccgccgcgacgcccgcgatgtccttcagcagggtccacggctcacgcacgtggtagagcaggcccgcgcagaggacggcgtcgaactcgcccagctcggtgaagtcgatccgctccacgtcggcgacgcgcagctccacgttggtgatgccgttgacctccatcaccagctccgcgcggcgcaggttctccggacggccctccagggcaagcaccgtcgtgccggggtgccgggcgagggcaagcgtgtccgcgccctccagtgcgccgagttcgaggatccgccgcgcgtcgggaaacgcaccgaagaacttcgcggcccggtcggccggggactggctcagcagataaccgtgctgggagccctcggcgtaacgcactccgtcgtgctcgaatccattcacccacggctcgagcgcggcgacgcggcgacgaatctcttcacggtccatgggatcaaagcctagcgatgccattgcggttgcggactagtgttttcatcatattcagcggctcgccgtgctgagcctttcgttgaccagccgggcccattccggaatccggtccccgccgatctcgatatcgaaggacgactggagttccgccggcccggcgtcggccgcccacctggcggtgcgggccagtccctcggccagcggggtgtccgtccagtcgccgaagaccgatcgggccagctccgtcgcggtgtacgcggttcgcacctcgtcccgcgacggcaggtgggcgatcggatgctccggcacgccggccgccgaccgtaccgcctgggccagctccagcacggtgttggtgctcgacgagcccacgttgaatgcccgcccccacgcggcctcggtctcggcggcgcggctgaccacgttcaccacgtcaccgacgtacgtgaacgcgcggacctggccgccgtcgccgtacacggtgatcggctcgcctcgcaggatctggttgaagaagatggcgaccgcgttgcggtacgggtcccgcatgttctgccactcgccgtagacgttgtgcatgcggaaggcggtgaagggcagcccctgggtccgcatcgtcacctccagctcgcgctcgaccaggtacttggccaggccgtagctgtccgcggggacggggacgacggactcgcgcatcggcgtctcgccgtggccgtagaccgccacggaggaggcgaaacagaagaaccgcacgccggtacgcagcgacgcgttgatcagatttatgctgcccatcacattggtgccgtagttgagctgcttcaccgaatggctgatcgcctccgccgcgaaggcggcaaagtggaagacccgctcgaatcggttctcggcgaacagtgaatcgacgaagtccacgtcggtcaccgaaccgacggccaggtccaccccggccggaacccgctgccggctgccgccgctgaggtcgtccagaacggtgacccggtgcccattcctgaccaatgactccaccaggtgcgagccgatgaatccggcaccaccagtcaccagacaacgaaccatccggggctccttcgtcaatagatccggaaagggttgaccgagcgggcgatctgcggcgcgcccttcgtcggcgaacaccgacccccgagagaaagcttcgcctcagggcaccggcgaccggtcggcctgcttcttcagcggctcccaccagtcccggtgcgtccggtaccagtcgatcgtctcggccaggccgtcggcgaaggcgacctcgggccggtagccgagcgcccgcagtttcgcgtccgtcagcgagtagcggcggtcgtggcccttgcggtccggcacccgctcgacccggtcccacccggcccccaaggcgtccagcagccgcccggtcagctccatgttggacagctcagccgtgccggcgatgtggtagacctcgccggggacaccgcggtcgacgacggtctggatgccccggcagtggtccgtcacgtggatccagtcgcggacgttcccgccgtcgccgtacagcggcacccgtcgcccgttcaacagctcggtgacgaacagcgggatcagcttctccggaaactggtacggcccgtagttgttgccgcaccgggtgaggcagaccggcagcccgtgggtgcgggcgtaggccagggcgatcaggtccccgccggccttcgccgccgcgtacggggagttcggcgccaggggggtgtcctcggcccaggaaccctcgtcgatgctgccgtagacctcgtcggtggagacctggaccacccgggcgaccccggcgtcgagacacgcctgcatgagcgtctggacgccctgcacgttggtgcggacgaactccgccgagtcggcgatggaccggtcgacgtgcgactcggcggcgaagttgaccaccacgtcgtgcccgggcagcacctcggccagcagcgccgtgtcgcagacgtcgccctggacgaaggtgatccggtcctggaccggttcgaggttggcgaggttgcccgcgtacgtcagcttgtccagcaccgtcacccgggcctgcgccgtgtcggggtaggcaccggtggccaggtcgcggacgtactgcgagccgatgaaaccggcaccgccggtgaccaggacgcgacgcatcagacccccacccggacttcgctgtgatcgccgaggacgaaccggtgcgtcttgggcacccggggcccggggaccacccgcgcctcccggccgatcatcgagaactcgatgcggccgatgccctcgatgtaggcaccgcgcagcacgatggagtgctcgatctcggtctccagcagggtgcagtcgcagtcgatcgaggtgtacgggccgaggtaggagttgcggatgatcgagccggctccgaccaccaccgggccgacgatccgggagccgctgacgtcggcgccggcgctgatcaccaccgggccgatcagttcggtgcggtcgtcgaccttgccctcgaccaaaggctcgacgctgccgaggacgaaccggttcatctccagcatgtcggcgaggttgccggtgtccttccagtagcccgtgatcatggtggagtcgacccggtggccgcggtcgatcatccactgcaccgcgtcggtgatctccagctcgttgcgccaggacggcttcagctcggccacggcatcgtggaccaccgggctgaagacgtagaccccgaccagggccaggtcgctcttggggtgctcgggcttctcctccaccccgatcacccggccgtccgcgcccatctcggcgacgccgaaggcgtgcgggtcggcgacccgggtcagcatgatctgcgcgtgcggtcgctcctgccggaagcgctcgacgatgtccttgatcccgccgacgatgaagttgtcgccgaggtacatgacgaagtcgtcgtcgccgaggtagtcgcgggagatgagcacggcgtgcgccagcccccggggagcctcctgcggaaggtaggtcacctggaggccgaactgggaaccatcgccgaccacgcgctgaatttcgggcgcggtgctgccgacgacgatgcccacctcctcgataccgccctcacgaatagcctcgagcccgtagaacagcaccggcttgttggccacgggaatgagttgtttggcggacgtgtgggtgatcggacgcaatctcgatcccacccctcccgccaggaccagcgccttcacgaacgccctcgaaaggatgggaccgagacgggtcgctggttcacgagcactccaggggtcacggtggactgggctcttcgtgaacgtaccgaaggatcactcgtgatttccctacttatgggccaccgaggtgtgatcggtggatctctatgcgtccgccatttccgcaaacgggggcctggccggcccgccgccgaccagttcgagcacggcggccaggccgtgcacggtgtccggcgggctggccggcagcagcagggtctgcaggccggcgtacaccgccccaccgtcggccagggtgtcgcccaccatcagcgcccgctccggggcgaccttcagctcgtcgcaggcggtgcggaagatccggggatcgggcttgaccgcccccacctcgtgggagaagacgtaggcgtccaccagctccgccatcccgtacgccgcgaaggtgggccgcaggtcccaggcgatgttgctgaccacggcggtgcccacgccgcgccggcgcaactccgccaggaccggggcggcgtcgcggtagggcagccagccgtccgtgcggaacagccggtcgtagagcgcctcggcgaggccgggatggggcaggtcgacggtggagagcaggcccacgtacgcgctgcggtgcgtttcgggcgagaggtcccggcgggcgtacacctcggcgagccccggcgggacggcgtgcggctccggcccgccgggacggccggccgccagcagcaacccggtcagggcctcctgctgcgccgggtcgagctggacgccgacggtggccgccgccgcccgcagccaacgctgcggcagttccacggcgaacagcgtgccggagaagtcgaacaggacggcgtcgatcggacggggcaggggggtcgtcatcgctctcctcggtgcagccgcgtcagggcggcaccagcctggcagcggaccagccggatgtccatcatggaggaatgcgccgggtcgggcgcgcccgccatggccgccggtccggacgacaggcattttcggtcactcttgccttctaggcggatttcttcaaagatggctgtcaattcttcagcgatcctggaggcatccgtgacccgtacccgaaccgccctgcgccggctgctcgccgccggtctggccagcctcgccaccgctgccgcgaccctcgtcgccaccgccggcccggcggcggccgccaccacccccggcatcgacgtgtcccactaccagggatcgatcaactggacgagcgtccgcaacgcgggcatccagttcgcgttcatcaaggccaccgagggtacgagctacaaggaccccaacttcaacgccaactacgtcaactcctacaacgccggagtgatccggggggcgtaccacttcgcccggccgaacatctcctccggcgccacccaggccaactacctggccagcaacggcggcgcctggtcggcggacagtcgcaccctgccggccgcgctggacgtcgaggccaacccgtacagcggcggcacgtgctacggcctcagcacgtccgggatgcgtagctggatccaggacttcctgaacacgtacaaggcccgcaccggccggtacgcggtcatctacaccaccacgagctggtggaaccagtgcaccggtagctggaccgggccgtgggccaaccacccgctgtggctcgcccgctggtcgagcaccccgggcaccctgccggccggcgcttcggtctggagcttctggcagtacacggcctccggcagcgtctccgggatcagcggcaacgtcgaccgcaacaactggaacggcgaccgcacccggctgatcgcgctggcgaacaacacctgacccgaacgcccgggtaggcggttggcggcagcggaaccgattgcgaccgtacggtcggcggccggtccggctgccgccagcccgtcacccggcccgcgtcgcgggccgcgccggcatccggtcctgccggcccggggtggcccgccgtgccatccgccaggcggccacgcctgcgacggcgccggccacgacaccgaacagcgcgaacagcaccggaagacccgcgctgaccagcagcagcaccacgtcgccgaaggcgacgagcatccacagtgccagcccgggtcgagcgtccctgcgtcggtgtcccatgtcgcacctcctcgcatcgtccgggatcagataccccgttcgacgcaagtacatgcgaatcgacatcgcaacggcgggaatcgcctgctcagcgggccgagtcggcaatggacggccccggccgggcgctcagtcgacccggtccggcttgaagcccttggcgatccggtcgaagtcggccagccgcgcctgccagtccttgttcgccacctcccaccggagggcgtacccccggttgctggccgtgacgaagccccggttgcggacgtggatccgagtgccgtcccggttctccaaccactcccagtccgcgcacgtcttgtagtagtcgcagcgcttgatgctcagatactggtagccgttgacgtagttcttccgggccggttccttctctttccagtcggcgtaggcgtcgccctccggggtgctggtccactgcaccagcagctcgcccaccccgtcgcgctcgtcgaagacgatcgtgttctgccccacgctgcgccgcacccagcccttcggcaggggcagcgagaagcccgccgggtccttgtgcaggagccaaccctcgggcagggcgttcgggtccacggacgggctggcagacggcgtcgggctgggcggagccgcgctgctggtcgccggtgcggccgacggcgtcggcgtcgacacgcccgcctgcgggtcgccgccgggccccgggtcgtcgtcaccgctccggccgagcagcggcaccgccgccagcaggccgatcagcagcaccgcgacgagcgcgccgaccagcaggccgcggcggcgacgctcgggcttcgtgcccccgacgacggtggcccggcccgtcgacgagagtgccgggccggaggcggccggcagcaccgacgtcggggcggcctcctcgcggggcgcgacggcgggctcgcgggccggggcgggcggcgaaacgggcacagccgcgcccggatcgacccgggtgtcgtcggctcgggtgtcgtcggcccgaccggccgccggggccccgtcggccccttcgtccccagcctcggcggcccggtccgccggcggcccgtcactccctccggccggcgtgcccgcagcctcgtcggcgctggtcgcggcgtcgggggcggggatcttcgcggtgggatcggccgcctgcgggccgaagtcggtgaccttcgcggtcggatcggcgtcggcgctcggcaggtcgaccatcgcggtcggcgcggcgtccacccccgccgggaccttcgcggtcgcgtcgccgccgcccacgccggccgccgccgcgccaccggcggcaagaccaccttccggggtacgcggtgcgggcggggccgccggccggccggtgcgctgttcggcggggcgcggtgcgggcaccaccggcggtcgcggctcgcgcgggccgttcggccccggccggcgtacgccgtcgagcagcgagatggtcttggcgcgacgcccggcggcccgccgcaggagccgctcggccacctcggcgtcgatccgctcggccgggtccttgcggagcagcccgttcagcaccggcttcaacgggccggcgttcctcggcggcggcatcggctcggtggccagcgccgccagggtggcgatcgccgacggtcgggcgaacggcgacttgccctccaccgccgcgtagagcgtcgcgcccagcgaccagaggtccgcctccgggccggcggtgccgtcccgcgcccgctccggggcgatgtacgccggggagcccagcaccattccggtccgcgtcacgttcgggtcaccggggatggtcgccaggccgaaatcggtcagcaccacccggccgtcggtgccgagcagcacgttgcccggcttgatgtcccggtgcatgacgccggccttgtgcgccgccttcagcgcgccgagcacccccaggccgatctcgaccgccttggccggcgacaccggcccgtcctccgcgagagtgtcctgaagggacttcgacgccacgtactccatgacgatccacgggtcgccgtcggtgcgcagaacgtcgaagatgcggaccacgttgacgtggttgagtcgcgcgatggcacgggcctcccgcagcgagcgttcccgcatctcgcggcgctcctccggggtgaggctgggcggcgggaccagttccttgatcgccacatcccggtgcagcacctcgtcgcgcgccttccatacccgacccatgccaccctgaccgagcggcgaaatcagccggtaccggtcggcaacgagttggggaagcgcgttcgacatcggtggagacggtacccggcggcggcccgccgcacaccgccggcacgccactgtgcgacgaaggtcaagttcgcgacgcgtacgctgaacggcatgtctgccgaagagccgctgttccgggtgacccggggcgttccgaccgccgaggaactggccgcgctggtcggcgtcatcgtcgcccggacccgctccgccgccgctcacgcgcccgccgcgccgtcggcctgggcacgcagcggtcggcccggcggtacggtgctcgccgctcgcccgggagcctggcgcgcctccggtctgccccgctgacgcactcgccagcatgtggccagtgtggcccgccgccgaggcgggtggcggcgggggctcccggaggtcgacgacacccgttaacctcactcagggagacgatgccgtgacggatagggagggtcgatgattcccgaggaggaccgaccagcaccctggttgagcggctacggcagcatcgaggccgacatccgccagatgcgcgagttcgccgacaaactccaggcggaggtcgagcggaactacgcaccgcatctgtcgtacatagcggacgacatgaaggcacagatccccaaccccgccgacgccttcgtcgaactggtgcagttcctcaaggcgcacaacgagacccagcaggccaccgccacgatggtctggtccgtcggtggggccaccggccacctggccacggcagccggccggatcgccgagcagtacgccgactccgacgccttctccgccgctcgcgtctccgacgtggagcgggccctcgccaacccgggcgcggcggggcagggccgccccacgccggctctgcccgacccgaccagcccggacggcgggccggggcgggtggtgctgccatgatcgagcggggcagcggccggacgtccggcctcaccgactggcggctgatggacctgctgagcatgtgggcgtgcatccaggaccacgagaccgccgggcactggaagcaggtcgccggctggcgcaaggtttgcgacctcgcgcaggcccacctgggccgcctcaaggagtaccggcgcggcctggccgaggcgtggccaccggcgaccaacgccgccgcccgggcgtacctcggcgaactggacgacctgatcgacaaggtgcaacgcacccacgacgcggctgccgcgaactacgacgccctcgcggccgccacccgagcgatcagcagcgcccgcaccgaactcaagccgctacacgacgagtacgtggagaaactccagcagaagcgggcgtacgaggcgactaccgccgatccgaaggcgctgatgggcagccggctgccggacaagccggtgactgacgccgacctggaacgactcaacgcccaggcccggaacctgatgtacgggttgagcggcgaactccaacaggcccaagcaatgctccgccaaccccctcctccgcaccgcccaggacgacagccgaacaacccggatgcttacgagagcacaggcacgcctccggtcatcccgcccgtattaccagtcccaaccattaggccttcaattccctcaagcgctcagcaagcagagccacgccctgttcctgtccagagcgcaccccaaacaggtcctgtactcgggggaatcgggacgggaaacaccacttcgccatcgggctccatttctcccggcaccggccacccagtgacatccaacccggcaggaggtgctggccctaccctcccgccgaacttgccacctgccatcgcccccactggacgaggcagcacaaccggccaggtaggaaaccagccccgctcaaccacgtcctcacgaccattcttgccaggcggcctgatcggcggcgggcccgcgatggggattaatcaaccccttggcaatactcctccgcgaaggatcaacccaattggaggggtgatcgggggcggtggggctggaacctcaccaaccggcgctgcaggcactcgcccgggctcgggacgtggtccccactttaacctgacccctgcggcgcctccgaatggcgcaccgcaaggcgtcgtaaacaccttaggtctgaatggtgagccgtcacgctcatcccaccgcgagcaaggcgatactgacggccgctactgggatcccgaccatccatgggcaaccagcgagggcgttcctccagtagtccgcccgcccgaggcggagggaccaatcgacccagggccagctattggcttcgaccggtgaaaaacgctcctccagcgggcgctaccttcaccttcctagcaacattgatggttgcatcagcgtacgccccgagcgccgtgcgtgcgagtcctgaaaccgatggtgccttgcgaatacgggctgaccagtggcaccttaactacctgaaggcggcggaggctcagaagctgtcactgggagaaggggttgtagtagcggtcccggatactggcgttgatccacaccccgaccttcagcgcaatctaatcaaagggattgacatcattcccgggggcaatggagatggccagaaagatcgcaacagtcacggcactagcatggctggactaatcgcagcccacggacagggccagagcggcgccttaggcatagcacccagagccaagatcatgccaatcctgtcttccgcgtcgaacaacctcggtgatgcagacggcttggctgcgggtatagaatttgcaatctcgcatggggcggatgtcatcaatgtctccagcggaggcggcgccagcgttcgactcatcaaggcaatcagagaggcggtcgccgcagacattgtagttgtcgcagccgccggaaacagtcccgaagacatgacaattggctatccagccagcgaggaaggagtcgtcgcagttggcggaattgatcgacagggagagcatgcttcagtttctgtcgtcggaccggaagttgacttagtcgcaccggcagtcgacatctacagcaccagttacgacgggaagtactccaaaggcaccggtacgtccagtgccacagcgatagtcgcaggggccgctgctctggtccgatcgaagtttcccgacctgcccgcctcggaggtcgtccatcgcctcactgccaccgccatcgacaaagggccgccagggcacgacgaccagtacggctacggcgttatcgacctggttgccgcgcttacggcagacgtacccccggtgggctttgagtcggcgacggcggacgtgcccgacgtgcctgggtcgaccacgacggcggtcgccgagccggcaggcgagggtgacgatggggcaacggcccgaggtctggccacgttgggagtgatcgtggctgctgcgggcgcttgggcgctggtcgctcgacggcgtaggttgagcgacgacccgcccccgcggatcagccggtgaccagccagccctgacgccatgtcggcgacattggggggtcggggtgggtgggataccgctatttggccgacatgaagtcgatcaacagcgatcaacaggcagtgtgatcggcgggggtcggtcgacggccaggcggcgtcgacggaggcgggggaagcggtagcgtcggcgacgtgccgaactcgatttcactccgactcgtgctcgcgtcggcgagccctgcccgtcgcaagctcctccacgccgccggcatcgaacccgacgtgctggtcagtggggtcgacgagtcccaggtgaccagcgagcgagccgaggatctgtgcctggagctggcccgcctgaaggcgcaggcggtcgtcggccggctgcgcccgtcggccgacgagcggacgctggtgctcggctgcgactcggtgctcgccttcgaccgcgagattctcggcaagccggccgacgaggcggacgctacccggcgttgggagcggatgcgggggcgcagcggggtgctacacaccgggcactgcctgatcgacgtcatccacgagacgcgcgccgaggcggtcgcctcgaccaccgtgcgtttcgctgacatcagcgacgaggagattgccgcgtacgtcgcgacgggcgaaccgctcgcggtcgccggcgcgttcaccatcgacggaatgggcggggcgttcctggagggtgtcgacggcgacccgggcacggtggtcggcctctccctaccgttgctgcgccggcttctcggcgagctggacctgcggatcatcgacctgtggacgaaggtcgcgccgggcggccaggcggtcgaggcggtgggtacggtccagccatgacgacgaagtccctgccgctgaccccggaactgcatgcgtacgtggtggcccacggatcggacccggacgaggtgatgcgggatctgatcgaggagaccctcgccgcgctgcccgccgaggcgaggatgcaggtggccccggagcaagccgcgttcctgacgttcctcacccggttgatcggggcgcggcgggcggtggaggtgggcaccttcaccggcctgtcctccctggcgatcgcgcgcgggctggccgagggcgggcggttgacctgcttcgacatctcggaggagtacacgggcgtcgcgcggcggtactgggcgcgggccggggtggccgaccagatcgacctgcggatcgggccggccggggacacgctgcgcgggttgccgtacgaacggcacctggacttcgcgttcatcgacgcggacaaggtcggctacccggtctactgggcggagttggtgccccgcatgctcccgggcggggtcatcgcggtggacaacacgttgcgcgggggccgggtgctcgccccgcgtgacgccgacgaccgggccatcgccgcgttcaacgacgaggtgatggccgacgtccgggtggagccggtgctgctgccgatcgccgacgggctgaccctggcccgggtgcgctgacgggcgccagccggacgatcgtgccaggtcgccggcccggcgtcgtgtgtccgcctcaccgggtcgacgagggggtgaggcggggcggggtgttaggaaggggcccttcctataccgaatgcgttaacaaggggcccctccttacacctcaacctcagcgcacgctgcgggcgaactggcgggcggcccaggcgacgccgacggcggcaagcaccgcgatgatggtcaggccctgccagaccttgtcgttgccgaggtcgccggcgaagagggcccgggtgccgtccacggcccaggagaacgggttccactcggcgatgcgctggagccagccgggggcgaaggtgagcggcagcaggatgccggagagcagcagcaccggctgggcgacggtgttcatcaccggggcgagcgcgtcctcactcttgaccttgagcgcgacgccgtacgagacggccgaggtcatcagcgcgatcagggcgagcatcaggtacgccagcagcaggtcgccgatgaacacgcgcagctcgaacaggagcgcgagcagggtgatgatgacggcctgggcgagcagcgacacgacgtcgcgcagggcccggccgagcagcagcgcgagccggctgaccggggtgacccgggaccgttcgatgacgccggcgcgcagctcggcgatcaggccgaagccctggaagaggccgccgaagatggccagcagcaccagcaggccgggcacgaagatcttgtacgcctcggcctgggtcggcgcgttcagcgcgggcttgagcagcggggcgaagaggagcaggtacatcaccggctggaagacgccgacgaagacccagaccggattgcggagcaggagttgcatctggcgctgggcgacgagccaggtgtcgcgggcgaacttcatgatcggactccgggtggtcaggactcgcgcagcgagcggccggtcttggtgaggaagacgtcgtcgaggctggggcggtgcagctcgatcgagctgagcctgaggccggactggtcgagccggcgcaggacctgcgggatggcggtggccccctcgtcgacggtcaggcgcaggccgccgccgtcgacggtttccagcttggtgacgtacggctcggtgtcgagcagttgggcggcctgcggggtggcggcggcgtccagcccgacgagcagcacctcgccggagatctcccgcttcagcccgcccggcgtaccctcggcgaccacctcgccgtggtccatgatcgcgatccggtcgcagagcgcgtcggcctcgtccaggtagtgcgtggtgatgaagacggtcatcccctcggcgcgcagccgacggatctcgtcccacatgtgggcgcgactctgcgggtcgaggccgctggtcggctcgtccaggaagacaatgcgggggtcgtggatgatgccgagagcgatctcgacgcggcggcgctggccgccggagtaggtcttgcacttacggtcggcgtactcggtgagctggaaggcggccagtgcgcgctcggcgcggcggagggcgtcggccttgccgatgccgtacatccgggcgtgcaggaccagttcctcgcgggcggtggagtcgtcccaggtgctgccgccctgggcgacatagccgatccggcgacgcacctcggccgggttccgcagcaggtcggccccggcgatggtggcctggccgccgtcgggggtgatgagggtggccagcatccgcagggtggtggtcttcccggcgccgttggggccgaggaacccgaagatctccccctcggcgacgtccaggtcgacgccgcgcacggcgtcgaccgtcttgtgctgtcgaccggcgcgggagcgaaacgacttccgcagccctctggtctggatcatcttcgctcctggtcgtccttagccggaccgggccggccctctctccgggacgccacgccacacgggtggccccgaacgtcgcgccgaggctaacgcgatataacttctctagtcaactttgattaatggcgaccgtcggccccctcccccacgttccagccgtcctgactggccaacccttcgggcagatacggcacgccggcctcgatccggtcggcgacccgctcacaccaggccacctcgacctctccccgggcaatccacagctcgtacatccagctcacgccgaccggcttggagtcgcggatccaggaggactccatcgaggcacgcatggtttcgacactggcccgcagcacctgcccccgactgcgcagcgcggccaccgcctccggcctgggcagcgccggcaggaacgcgaacgccgccacgaacggatcgctcgtctgatgattgccccaccacaggccgcgcagcagcgtctcgaactcgtcgacccccttcggggtgatctcgtacgtcgtccgcgcccgccgggcgccgacctgctcggtggcgacctcgcggagcagcccctcctcgccgagcttgcgcagcgcgtggtagatcgagccgggctgcacgttggcccacttgtcggcaccccaactgagcagctcgcggcggacgtcgtagccgtgcaccggctgcatccacttgaccaggccgagaatcatcatgcgagtggcagacaccggaaaagcgtattagacaagtttgactatccaagcatctgggcagtgcctcatcccacactgagcgatcgttagggccacgacgccggccgataaactccccgtcagtaacatcccgggaggagccacgaggtgcgcaaggtactcatcgccaaccgaggcgagatcgccgtccgcgtcatccgcgcctgccgcgacgccggcctgggcagcgtcgccgtctacgcggactccgaccgggacgccctgcacgcgaccctggccgacgaggcgtacgccctgggcggcgacaccgccgccgagacgtacctgcggatcgacaagctgatcgccgtcgcggcacaggccggggccgacgccgtccaccccgggtacggcttcctcgccgagaacgccgacttcgcccaggccgtcctcgacgccgggcttacctggatcggcccgaccccacaggcgatccgcgacctgggcgacaaggtcaccgcccggcacatcgcccagcgggccggcgcgcccctggttcccggtacctcggacccggtcggcagcccggacgaggtgatcgcattcgcggtcgaccacggcctgccggtcgccatcaaggccgccttcggcggcggcgggcgcggcctcaaggtggcccgcacgatggaggagatcccgcacctgttcgagtcggccacccgggaggcggtcgcggcgttcggccggggcgagtgtttcgtcgagcggtacctcgaccagccccggcacgtcgaggcccaggtcctcgccgaccagcacggcaacgtgatcgtcgtcggcacccgggactgctcgctgcaacgccggcaccagaaactcgtcgaggaggcccccgcgccgttcctcaccgacgcccagcgccggcagatccacgacagcgccaaggcaatctgccgggaggccggctaccacggcgccggcaccgtggagtacctggtgggcacggacggcacgatctccttccttgaggtcaacacccgcctgcaggtcgagcacccggtcaccgaggaaaccgccggcatcgacctcgtccgcgagcagttccggatcgccgacggcgagaagctgcggctggccgaggatccgaccccgcgcgggcactccatcgagttccggatcaacggcgaggatccgggccgcaacttcctgcccgcccccggcaccgtcaccgcgctgcggctgcccaccggccccggtgtccgggtggacaccggcatctccgccggcgacgtgatcggcggcaacttcgactccctgctggccaaggtgatcatcacgggcgagacccgcaccgaggccctggagcgggcccggcgggcgctggacgagatggtcgtcgagggaatggccacggcgctgccgttccaccgcctggtggtacgcgaccccgcgttcaccgccgcgccgttcaccgtgcacacccggtggatcgagacggagttcgacaacaccgtcctgccgttcaccgccgccgccggccccgccgagggcccggccgagcgggagaccgtcgtggtcgaggtgggcggcaagcggctggaggtgaccctccccgccggcctcggcgcgggtacggccgccgggcccgccgcgcggaagccggcccggcggggcggcggggccaaggccggcgcggcggtcggcggcgacgccctcacctctccgatgcagggcacgatcgtgaagatcgccgtcgcggacggggacaccgtcgccaagggcgacctggtcgtcgtgctggaggcgatgaagatggagcagccgctgcacgcgcacaaggcgggcacggtcggcgggctgtccgccgaggtcggcgcggtcctcgccgccggcgcccccatctgcaccatcacctgaggtgcaaggaggggccccctgttaacgcattcggtataggaagggccccttcctaaccacgcgcccggcggggccgcgccccagcccgggtacgcgtaccggccgggggtgttttccgcgaccaccgcgagcggtgaggaccggggccgggaatgatggccaggtgcggttcctacatggcgcggttcccgcgcacgacctgacctacaacgacgtcttcatggcgccgaaccgctccgaggtcggctcccggttggacgtcgacctggccacctccgacggcacgggcaccaccatcccgctggtggtggcgaacatgacggcggtggccggccggcggatggccgagactgtcgcccggcggggcgcactcgcggtgatcccgcaggacatcccgatcgaggtggtggccaacgtggtcgcctgggtcaagcaacggcacctggtgcacgacacggcgatcacgctcggccccaccgacaccgtcggcgatgccatccatctgctgccgaaacggtcgcatggcgcggtggtggtggtcgacgaggccggtcggccgctgggcgtggtgacggaggcggacaccgtcggggtggaccgcttcgcccagctccgccacgtgatgtcgaccgagttgcacacggtgccggcggacgcggacccgcgtaccggattcgaccggctctcggcgggccggcggcggctcgcgccggtggtggacggcgacggccggctcgtcggggtgttgacccgcaagggcgcgctgcgcgcgaccctctacaccccggcggtggacgaccggggccggctgcggatcgcggcggccgtcggcatcaacggcgacgtcaccggcaaggccgccgcgctgctggaggccggggtcgacgccctggtggtggacaccgcgcacggccaccaggcgcggatggtcgccgcgctgcgggcggtgcgcaagcttcacccgggcgttccggtcgcggccggcaacgtggtcaccgccgatggggtacgcgacctcgtcgaggccggcgccgacatcgtgaaggtgggcgtcggtccgggcgcgatgtgcaccacccggatgatgaccggggtggggcgtccgcagttctccgcggtgctggactgcgcggcggcggcgcgggacctcggccggcacgtctgggccgacggcggggtacggcacccgcgcgacgtggcgctggccctcgccgccggcgcgtcgaacgtgatgatcggttcctggttcgccggcacgtacgagtccccgggtgacctgtacacggacgcggacggccggaggtacaaggagagcttcgggatggcctcgtcgcgggcggtcagcgcgcgtacggccgaggacagcgcgttcgaccgggcccgcaaggggatcttcgaggagggcatctcctcggcccggatgtacctcgacccggatcgcccgggcgtcgaggacctgatcgacgagatcatctccggggtacgcagcgcgtgcacgtacgcgggcgcgcgcagcctggcggagttcgcggagcgggcgctggtcggggtgcagagcacggccggctacaccgaggggatgcccctaccgacgagttggtgaccccgcgcccggcggtgagaagggttcccctctctaccggaggcgtcaacaaggggcccttccttcgtgcgcggctgggtatcggcgtgaccgactgccgcacgcgccgccgcacactgagccgccgcccgtcgagggcccaccgaacgggcgccggggtcagtcgaagaggcgacggatgacggtccgggcggcggcctccgggtccgggccggtgccgggcgggagcgccccggccagccagagtgtcacgaagccgtgcacgatcgaccaggcggccagggcgtccgcctcctggtccgggtcggtttcccggcgcgggagggcggccaccccggcccgcagcgccgcgccggcccgatcacgggcggctgtcacctcggggtcgtcgcgacggtagagctccgggcggaacatcacctcgaagtgggcccggtggtcgaccgcgaaccggacgtacgccacgccggcgtcgagcaggtcgccggcctcgcacagcgccccggccagcaggtcgaatccctcgacggcgagcgcggtgagcagccccgccttgtcgccgaagtggtgcgcgggggcggcgtgcgagaccccggcccggcgggccaggtcgcgcaggctcagggcggccggcccggcgtcggtgatcgcgtcgacggcggcggcgagcagggcgcgacgcaggtcaccgtgatggtagccacgcggtccggtcatgccggcagcctaacttgtcattgacaagatagccaggccgaagcaatctaggcaatgacaagttgccttcgaccgaggagaaccccgatggcgcccctgatcgctctcatcgccggctcggccctggcccgactcgccgggctactcaacgtcgacgccctggccggctggcaccccgccctgcgggtcgggctcgcggccatgttcgcgctcaccgggatcgcccacttcacctcccgacggcccgacctggtcgccatggtgccgccccgactgccccacccggggctgctggtgaccgtcaccggcctgctggagttggccggcgcggtcgcgctgctcgtccccggcacggcgcggtgggcagcggccgggctggggctgctgctgctcgcgatgttcccggccaacgcctcggccgcccggcgcgggctgaccctggccggccggccggtgaccccgctcgtcccccgcgcgctgctccaggtgatcttcctcaccgccgccgccgcgatttcgtttgggccctgactatcagggagctaacatgacccgcatggagctgatagggctgcgagacgtgccactcggccggctgctggtgaccgccggccacgtcgtcggccaacggtggaaccgctacctcgccgaggagcacggcctcacccaggcgggcatggtcaccctgatgaccctggcccggcacggcgagctgccgcaccgggcggtcgccgaggcgtgcttcatccgcccggccaccctaaccggcatcgtcgacacactggagcgcgacggcctcgtcgagcggcaacgcgacgacgtcgaccggcgcagcgtgcggctcgtcctgacccccgccggtcgggaacgggtcgccgcgctcaccaacgtcatgcagtccggacgaccgatgacctcggtcgacgccgacccggcgaaggccgccgtgatccggcagttcctgctcgaggtcatcggcagtggagaggaacctcgggtgacggccctcgacgcgaggccggaggctccggcatgctgatccggctgctccgcgcccacctgcgcccgtaccgtcgaccgctggcggcggtgatggcgttgcagttcgtcggcacgatggcctcgctctacctgccgagcctcaacgccgacatcatcgaccagggtgtggcccggggcgacaccggctacatcatgcgtacgggcggctggatgctgctggtcagcctggtgcagatcgcctgctccaccgccgcggtcttcctcggcgcgcgctccgcgatgggcttcggccgggacgtacgcgccgaggtcttcgcccacgtcaaccggttctccgcccgcgaggtgacccgcttcggcgcaccctcgctgatcacccgcaacaccaacgacgtgcaacaggtgcagatgctcgtcctgatgagctgcaccatgctggtcgccgcgccgatcatgagcgtcggcggggtgttcatggcactgcgggaggacgtcgggctgtcctggctgatgctggtcagcgtgccggcgctggcgatcgccctgatgctgatcatccggcggatggtgcccgggttccggctgatgcagacccgcatcgacgcggtcaaccgcgtgctgcgcgagcagatcaccggcatccgggtggtccgggcgttcgtccgcgagccgtacgagacggcgcgcttcggccgcgcgaacgccgacctcaccgcgaccgccctgcgcaccggtcggttgatggccctgatcttccccgtggtgacgctggtgctcaacgtctccagcgtcgccgtgctgtggttcggcgcggaccgcgtcgacgccggccagatccaggtcggcgcgctcaccgccttcctgcagtacctcatgcagatcctgatggccgtcatgttggccaccttcatcctgatgatggtcccgcgcgccgcggtctgcgccgagcggatcgtcgaggtgctcgacaccgactcgacggtgatcccgccggccgcgccgacggccgaggtgaccggccggggcgaactggaactgcgcggcgtccggttccagtacccgggggcgagcgcgccggtgctgcacgacatctcgttccgggccacgcccgggcgcaccacggccatcatcggcagcacgggggccggcaagacgaccctgctgacgctgatcccccggctgatcgacgccaccgccggggcggtgctggtcgacggggtggacgtgcgtgacctggccccggacgatttgtggcggcggatcgggctggtgccgcagcggccgtacctgttcagcggcacgatcgccagcaacctgcggtacggcaacccggacgccaccgacgcggagctgtgggccgccctggagatcgcccaggcgcgcgacttcgtcgccgagttgcccgaagggctgaacgccccgatcacgcagggcggcaccaatatctccggcgggcagcgccagcgcctcgcgatcgcccgggccctggtccgcaagccggagatctacctgttcgacgactcgttctcggcgctcgacctgggcaccgacgcccggctgcgcgcggcgctacgaccggtcaccgcggacgcgacggtgctgatcgtggcccagcgggtctccacgatcgtcgacgccgaccagatcatcgtgcttgaggacgggggcatcgtcgggatgggccgacacgccgaactactggaagactgcccgacgtacgcggagatcgtcgcctcccagcagacggcgggggtgccggcatgacggccgtaccggatcagcggcccaccgcgcggccggcggaggggccgacgccgaagcggctgccctccggcaaccagggcagcggcccgaggtggatgagcgccggcatgccggccgagaagtcgatgaacttcgggccgtccacccgccggctgctgcgccggctgcgaccgcaccgcctccagctggccgccatcgtcctgctctcgctggtcagcgtcggttgcaacgtgtacgggccgaaggtgctcggccacgccaccgacctgatcttcagcggggtgatcggccggcagttgccggccggcaccaccgccgagcaggcggtcgcggcggcccgcgcggccggtaacgacagcttcgccgacatgctggcccggatggacgtggtgcccggggtgggcatcgacttcaccgccctgggccgggtgctgctgttcgtgctcgccctctacctggcggccagcgtgctgttgtggtggcagggctggctgctcaacggggtggtgcagcgcacggtgctgcggctgcgcgccgacgtggaggacaagctgaaccggctgccgctgccgtacttcgaccggcagccccggggcgagttgctcagccgggtcaccaacgacatcgacaacatctcgcagagcctccagcagacgctgagccagctgctcacctcgctgctcaccgtggtcggcgtactggccatgatgttctggatctcgccgctgttggcgctggtgtccctggtcgcggtgccgatgtcggtggtggtcaccagcctggtcgcgaagcggtcacagcagcggttcatcgcccagtggacgcataccggagagctgaacggccagatcgaggaggcgttcaccggacacgagctggtcaaggtcttcggccggcagcgcgaggtggaggccgccttcaccgccaagaacgaggagctgttccgggccagcttcggcgcccagttcatctccgggatcatcatgccggcgatgatgttcatcgggaacctcagctacgtcgcgatcgccgtggtcggcgggctgcgggtggcgtcggggtcgatgagcatcggcgacgtgcaggcattcatccagtactccctccagttcacccagccgctgacccgggtcgcctcgatggccaacctgctccagtccggggtggcctccgccgagcgggtgttcgcggtgctcgacgccgaggagcagagcccggacccggcggtgccggcccgggtcgccgaccagcgcggtcgcgtcgaattcgaccacgtctcattccggtacgagccggacaagccgctgatcaccgacctgtcgctggtcgccgagccggggcacacggttgccatcgtcgggccgaccggcgccggcaagaccaccctggtcaacctggtgatgcgcttctacgagctggacgccggccggatcaccctcgacggggtcgacatcaccacgctgagccgcgacgacctgcgcggccggatcggcatggtgctccaggacacctggctcttcggtggcacgatccgcgacaacatcgcgtacggccggccggacgcgagcgaggaggagatcgtcgccgccgcccgggcgacgttcgtggaccggttcgtgcgtagcctccccgacggctacgacaccgtcatcgactccgagggcagcaacgtcagcgccggcgagaagcagctcatcaccatcgcccgggcgttcctggccgagccgtcgctgctgatcctcgacgaggcgaccagttcggtggacacccgcacggaggtgctgctccaacgggccatggcggcgctgcgctcggaccggaccagcttcgtcatcgcccaccgtttgtccaccatccgcgacgcggacctgatcctgatgatggagcacggtcgcatcgtcgagcagggcacccacgagcagctcctggccgcccggggcgcgtaccaccggctttaccaggcccagttcacccagccggacccggccgccgtcggggaccccgagccccagcccgcctcggtccggggctgaccgtcgtggcccggtacatcccgcccagctccccgacccgcaggggcagctcccggggccccgggcgcggaagaccagagcgtggtgcgggcagagcgccgggcggagcacgaactcgtcgtcggggcccagccgcatcggcgggaacatgtcgtcggcgaagtggccgaggtcggggcctcgatgacggtgacgtcagtgcggcgcgccggggttccccgacgtcgtggtccgtaccgcgctgcgcatggggagacggtaggccggccgggggcgggcgcgcatccgaattcggggccggcccgacgcagccgagacgcatccggttaccgcgaagggcgacaggccgccagtcgctacagtcggcaacccggccgatgcacagcgcgcctcggggcgggccgccggcacgggacctgccggcggcccatggcggcccggtcgtcggctacggggggtccgacactcgaggccgcgccgactacggtacgccggccgtcggcgatccgccgaccgcctccacccgtacgccgaggttgccggccccagcgggtccccggcccgccgcgctgcccgaccgccgcgtcgccggcccgacgacccggttcgtggcgggtgccggcgaggtggagccgcccagttactccagctcgtggagcatgagctggcgggcggcctcggtgatcgagcccgacaggctcgggtagatggtgatggtctgggccaactcgttgaccgtgaggttgttctccaccgccatggtgatcggcaggatcagctcgctggccttcggtgccaccaccacaccgccgatcacctggccgctggccgggcggcagaacagcttcacgaagccgtcggcgaggtcgtccatcttcgcccgggcgttgcccgacagcggcagcatcacctggcgggccggggtcttgccggcgtccacctcgtcctgggagacgccgacggtggccaactccgggtcggtgaagacgttcgcggccaccgtacgcagccgcagcggccggaccgcctcgccgagcgcgtgccacatcgcgatccggccctgcatggcggcgacgctggccagcggcaacaccccggtgcagtcgccggcagcgtagatcccggggacgttggtgcgggacacccggtcgacggtgacgtagccgccccgggccagctcgacgccgtactcggcgaggccgaggttggcggtgttggggatcgagccgaccgcgatgagcgcgtgcgagccgtgcaccagccggccgtcggccagttcgacctccaccccgtcggcgatgcgctggaccctctcggcgcgggagttgttgaggatcgtcatgccccgggagcggaacacgcgctcgatcgccatggcggcgtcggcgtcctcgtgcggcatcacccggtcccggctggagacgagggtgaccgggacccccatggccaggtacgcgctggcgaactcggcaccggtgacgccggaaccgacgacgatcaggtgctcgggcaggtgcggcaggtcgtacacctgccgccaggtcaggatgcgctcgccgtccggcacggccgtggggagctggcggggggtggcgccggtggcgaccagcacggtcgacgcgtcgatcgagtgcttctcggagccgtcggccggcgtgacgacgacgcggtgggtgtggcccagcatgtcctcgccgagccgggccgtgccggccacgaaggtgacgccggctttcaccagcttcgcgtggatgtcggcggactgggccagggcgagccgcttgacccgctcgtgcacggcccgggcgtcgacggtgaccgcctccagcccgtcggagtgcaccccgaactcctcggtgtcccggtacccggtgaccacctccgagctggcgatgaacgttttcgacggtacgcagtcggacagcacgcaggcaccgccggccccctcggcctccaccacggtgacatcagcgtccaactgggcggcgaccagggccgcctcgtacccggccggccccccgccgatgatcacgatctggctcacagctatcgcccctcgtccgtgctcacagtgactttcttctccccgacgcgtccgacacgcaccgtcgtattctcccccagccgtccgccgggctatcgtcatcgccgtgcgtcactacgccgcctacggctcaaacctggaccccgcccggatgcgcgcctactgcccgcactccccgatggtcggcgtcggctggctggagggctggcggctcaccttcgcgggtgagggcgcgatcggctgggagggcgcggtcagcaccatcgtcgagtcccccggtgatcgggtgttcgtggcgctctacgacatccacccgtacgacgccgtccagctcgacgagatcgagggggtggcctccgggacgtaccgcaagctgcacgtccgcgtctccaccctcgacggcgacgtgaccgcgtgggtctacgtcttcgacgggtacgagggcggcctgccgacggcgtggtatctgtcggagatcgccaacgccgccgagaaggcgggcgcgcccgacgactacgtcagcgagctgcggtcccgccccaccggcacggcgtcggcgtagcgcgtctcccacactcccagtctgctccgcccgagacggggccgcacggcggcccccgccgggggtcgtctgtcacacatcatggtcgcgcccgtcacaccgccgtggcggcggggacggtgcgctcgtacatgtcggtccagcgcatctcgcgcagccccaccgagcggtagagcgtcgccggggaggtcgggttggtcaggtcgacgccgaggccggcgtgccgccgtcccttcgccgcgtagaccgtgaaggcccgccacagcagcgcggcgccgaccccgtgccgccggtacttcggcagcaccgacagggtccgcacccagcccgagtcctgttccagcgcctggtcggacgactgcaacgcgccggccggctccccgtcgacctcggcgacgaaccactcgtcccaggtcctgtcgtacgcgggcagacgctcccgccagtggtcgtacccggccggctcgtagtccggggtgtcccggaacgccgtgtcgtagatccggtggaacaggcgcaggtcgtcctcgtcgccggcgcgcagcggccggaccgtcaccccgggtgggggcggcggctcggcgggcagcccggccaggtcacgactcatccgtacgtaccgcttcacccggctgaaaccggcctcggtcagctccgtcacccagcgggtctccggcgggtaggccgaggcgcggacggtcagcgcgggcaggctccgctccgcggcccgctcggcgacccggtccagcatcagagcgagcagcggggcgcgtaccgcctcggcgcgctccgggtcgacgaggacgtcgacgaactcccggcccaccccggtcgggttgtccaccaccgaccaggcgacgagccggccctgcgggtcgctgaccagccaggagtcgcgcgccgggtcgaagaagggggccgtcagggcggccttgacgtcttcggcgtcgaagtccgggtggccgatcgcgaaggtgtctgcggcgtgcacgacggcgaggatcccagggacgtcgtcgagggtggggcggcgcgccgcccagtcagcgggaagagtcacggggcgatcctggcagccaccccggtcccgcgcccctcattttcaaccgccccgcgccctgcccccgccgccgcacgcgctcgccggcgagaggggaccctttctaccccaggcgttagtaaggggcccttccttgcaccacggcgcgtgcggtggtcagcaggtcgagcagcgcggtgccctcggccggcgtgagcgcccggaatccggtcgacaccagccggtcggtcaccgcctccgaccacagccggcggcgcaccagcggcccgacccgggggtacggcggcggccagccgcaggccagcgccccggcctccccctccggcccggccagcaccgcctccagcggcgtcatcccgccggcccgcaccgccagcaggtacgccccggcgaagtgctcccgaagcagcagcagcccggcggcggcacgggcccccggggtgtcgtccggcggcggcacggcccgccaggcggcaaagagtggcatcccgctggcgtccgcggcgtcgaccacccggtgcagcagcgtcgccagacggatcacgccgggcacggcggtcaggtgctcgctgccccaccggcagcactcggccaggttcgccgtggccacctccagcggagcgtgcacgcgggcggcggcgtcccacccgtcggcgaccgcgtcgggggcgacgaagccgagggccgcgctcaccgtggcggccccgacgtcgccgagcaccccggcccggccggcgatgtggaaggcccagccggagatgcccagcagacgggcccggtgcagggtggccgggcagcgggcgaacatctccccgagctccagcaccaacggcttgctcgcggcggcgacctgctccggcgtcatcgggttcagtctgccccgccggggccttccgtgacagccccgtcttcggcgtcgaccgcctcgatcgccccctcgatttcgccggtgcggcgctgggcggcggtgacggcccgttccgccgcccgccgggccagcttccgccggctgagttcctgctcggcctctgcgcgcgatcgctccagctcggccagcgaccgctcgatgccggtcagttcctcggcaccgtcgtgctcggcctccaccgcgccggccagctccgcctcggcccgctcctggtcggtacgcgcccgcgccagttcccgttccagcatccggcgttgccgggcccgctcggcacgggcggcgcgctcggcctcccgggcggcccgcttcgcgcgcggtggtgggtgggtgggcggtggctgctcctcgccgccggtgaccaaacggagctgggggcggggcacctcgccgaagccggcgtagctggcggcccgcagcagccggccggagcgcacctgcccggccacctccgtgtcggagagcgcggcgtcgagcgtcgcctccacctcgcccagcggcagcttcccggccggcgggccgccctcggcgtcggcggccagccggcgcgcctcggcgaccagcgcggcgaccgccgcccgccgctgggcggagagttcccgcagccgggggccgcgcaggtcgcgctgggcgcggcgcagcgcctcggcgagttgggtcaggtcggcgaccagctcggggcggcgcagggcgagcaggttgaccagccacgcggccacggtcgggcggcgcagccgggcgatctcgcgggccgtggccgggtcgccggagcgccgggcctcggcgacggcggcgtcgcgggtggcgacgaacttctccggcggctcggtgtagagccgccggaggaggctctgcgggggcggcacggctcagacgtcgagccggctgcccggctcgaggcgctggtagtcggtccccgacagcgcggcgtactgacggttgaggacggcgaggccgttgtcgttgagcagcccgtcgtgcagggcgaaggctcggcgcggggcgaccgcgcggatgaagtcgagcacctcggagaacttcgaccagggggcgtggatcggcgcgaagagggtgtccacgggggcgtcctcgggtgccaccagggcgtcgccggggtggtagacgacgtcgttcagcagatacccgaggttgtccacgaccgggatgtcgggatggatgacggcgtgccgaccgccgtacgcgcgcaccgccacgcccgccgcggtgaacgcctgcccgggtgagatgggctccagggcttcggccacgtcgccgagggcaccggccagcgaggccgggccgtagatgcggaacggccagcggtcgagctgccgggtgagagccgcgacgtccacgtggtcggggtgctcatgggtgatcagcaccgcgtccgcaccgtccagcgcggtcgggtcgctgaagacgcccgggtcgacgaccagcacaccgccgtcgtgctcgacgcggaggcaggagtgggcgaatttggtgagctgcatcgtgactcctcgattgacccaatcgtgatgtccctcagcgcagtctgccggaaccggcgcggtgccgcgtcgcgtctgaggtatcgcccgatggggcgtagacgatcggagcgggaatggacggacacgcaagacgcaggttgctgaccgcggtggggctggtggcgctgctggcggccggtggttgcagcgccgacagcgatggggcgggagagccttcggcggcggtggcgcccgagcaggcggcacctgccgacgggggcaaggcggagcagggtgccgatgccgggggaacgcggtccggcgcgggtggcggctcaccggacctgcgggtcgaccagcggtcaatcatctacaccggaaccatgcgggtgcgggtggacgatgtggacgccgccgcccggtccgccatcacggcggtcaccggcgtcggcggcttcgtcggcggcgacgagcgcagcagcggcggaaccgccgacgcccgggcggagttgcaactgcgggtgccggcggagcggttcacggccgtcctggaggagttggcgaggctcggccggcaggagcagcgggcgatccgcacggaggacgtgaccgaggagaccgtggatctcgacgcgcggatcgccacccaacgggcccgggtcgagagcggtcgcaagctgctggcgcgggccacctcgatcggcgacctggtgacgctggagagcgaggtggctaggcgggaggccgacctcgcctcgctggaggcgaagaagcgccggctggccgacctgacctcgctctccaccatcaccctcaccctggtcggtccggaggcggaggcccgggacaccgagcccgacaccggcttcgtggtcggcctgcgcggcggctggacggcgttcgtcgcctcgctgggcgtgctgctcaccgtgctcggggcgctgctgccgttcgcggtggccctcggcgtgccggtggcggtgctgcttgcggtgctgcggcggcgccggcgtcgaccgccggcgccggccgtcaacgcgccgccgccagtgcccgcagcgcggtctgcaccatgacccggatgccgaccgcgatggccccctcgtcgacgtcgaacgaggcccggtgcaggtcgacgttcgggccggaccggccgacgccgaggcgggccagcgcgccggggacgtactccaggtaccaggagaagtcctcgccgcccatgctctgcggggtctccgcgaccccctccgggccgagcgcggcgtgggtcgccgccgtgagcacctggatcgcccgggcgtcgttggtcaccggcggccggccgcgtaggtactccaggtcgacggtggcgccggtgggggcgatgacgtcccgcaccacctgagcgacgatcttgggggcctggtcccaggtgtcgcggtccatcacccgcagggtgccggacgcggacgcctcggacgggatcacgttgtaccgggtgccggccgaggcgtggccgaacacgagcagcagcccgctgttggccggcacccggcggctgaccagggctggcacctcggtgaccagccggccgagcgcgtcgaccaggtcgacggtcaggtgcgggcgagcggtgtgcccgccggggccggtgagccggacggtgacgttgtcggcggcggcggtgatcgggccgacccgcaggccgaccttgccgacgggctggttggggtcgcagtgcagtgcgaagatctgcacgacgtcgtcgagaccgccggcctcgatgacctccagcgagccgcagggcaggatctcctcggccggctggaagatcagccggacccggccgtccaattcgccgaggttggcgagttgggccagcagcacgccgacgccgagcagcacggtggtgtgcacgtcgtggccgcaggcgtggcagacaccgtccttggtggaccggtagggcacgtccttgacgtcggtcagcggcagcgcgtcgatgtcggcgcggagcgcgaccaccgggccgtcggggcggccgtcgatgtcgcagatgaccccgttgccctttggcagcaggcgcgggcgcaacccggcgagcgacagctcgcgggcgatcagggccgccgtctcgaactcctcgccggagagctccgggtgggagtggatgtgccggcgggtggcgataaggccgggcatccggagggcgagcagatggtcgagctcgaagggcaaaggctgcgacccggacggcgactccggccaggccgacgacgccaggtggctgccgttcggcagcgtcaacgcactcgtcacgtcgaaatctcgatcactagaaacggatggatcatcagggatgacagccgccagcctagaccttcgacggtgactctgtgcaacatcattcccgtagcgatcggaccgcgcagcgtcacgaataccctggtggaagggctccataatctgcgggacagcaggtagatcgcggttgaacgccgtcatctgccccccacctcctacaacccgtaaccgattcggcggtcacgaaatcaccgtcgatccggggccgtcgctaccgaattgtcgcattagtcgtctcggttaactgccgctcggacaagtaaccgaccgcactcggcagtcggacgactcccgacggtgacacgacgggccgacctgctcccgcacatgctgtccgtcccaatcacccggacgggttacccactgccccgggtggcacacaccgggctgccccgggtggcacacacaccaggcgaccgtagccccgaacggttacgccccgcgacccctcatccgagacaaggggtcagaaccggtcgctggggcggtacgtcccccacacctggcgcagggtgccacagacctcgcccaccgtggcccgggcccgcagcgcctccttcatcgggtgcagcacgttcgccgtaccctcggcggcggcccgcagctcacccagcgcgcgctcgacggcgtcgctgtcgcgctccactcgcagcttggccagccgctcggcctgggcagcctcgatcgtcgggtccacccgcagcggctcgtacggctcgtcggcgtcgaccgtgaaccggttgaggccgaccaccacccgctcgcccgagtcgatctcctgggcgatccggtacgcggactgctcgatctcccgcttctggaagcccgcctcgatggcgtcgaccaccgagccgtggtcggccacccgctccatcagctccaccaccgccgcctcgatctcggcggtcatcgcctccaccacgtacgacccggcgaacgggtcgacggtggcggtcaggtccgtctcgtacgcgagcacctgctgggtgcgcagcgccagccgggcggccttctcggtgggcagcgcgatggcctcgtcgaagctgttcgtgtgtagcgactgggtgccgccgagcaccgcgcccagcccctggatcgccacccggaccaggttcacctcgggctgctgggcggtgagctgcacgcccgccgtctgggtgtggaagcgcagcatcatcgacttcgggttcttcgcgccgaactcgtcgcgcatcagccgggcccagatccgccgggcggcacggaacttcgcgacctcctccagcagggtggtccgggcgacgaagaagaacgacagccggggcgcgaagtcgtccaccgccagcccggcggcgagcgcggcccggacgtactcgacgccgttggccagcgtgaacgcgatctcctgcgcgggcgacgcgccggcctcggccatgtggtagccggagatggagatggtgttccacttcggcacctccgcccggcagtaggcgaacgtgtcggcgaccagccgcagcgagggcttcggcgggaagatgtacgtgccccgggcgatgtactccttgaggatgtcgttctggatggtgccgttgagcgccgcgcccggcacccccgcctcctcggcgacgagctggtagagcagcagcagcaccgaccccggggcgttgatcgtcatcgaggtggaaaccttgtccaacgggatgccgtggaacagcagccgcatgtcctcgatcgagtcgatggcgacgccgaccttgccgacctcgccgtgggcgatcgggtcgtccgagtcgtaccccatctgggtgggcagatcaaaagcgacggagaggcccatggtgccggcgcgcaggagctggtggtagcgcgcgttgctctccgtcgcggtgccgaagccggcgtactggcgcatcgtccacggccgcgaggtgtacatggtggagtagaccccacgggtgtacgggaactcccccggctcgcccagccgctcgggcagaccctccggcaggtccctctgggtgtagacacccttgatcgggaagccggactcgctcgaccgcggttcactcatccccggatggtaggacgtgccaccgcgccggagggtgagggattgcgcacatcgcacccctgtctttccccgccgactccgagggtgaacacctggccacgttcgctccgattaggtaaacgttccgccgcgtcgggtttcgcatcgggcgtcggaaccagcaagatagaggagttgtgtcccagccccctcgatttcccccggtggctcttctgtgactcagatcccgacgtggagcggcggaccagtcagcccaccccacggacgtgcggcagccggcaccaccatcggtgaccggtactcgctccggtccgcggtgggcaatggcggcatgggcacggtctggcgtgccacagacaccctgctgcggcgcgacgtggcggtgaaggaggtcgtcctcccgcccggcctcgccccgagcgaccgcgacgccatgtacgaacgcacgctgcgcgaggcccgcgcggcggcggccatccagcacccggccgtggtccaggtgtacgacgtggtcaccgagggtggtcgcccctggatcgtgatggagctgctggacgcccgcagcctggccgacatggtgatcgaggacgggccggtggccccccgcgcggtcgccaagatcggcatcgccctgctcggcgcgctggaggtggcccacgcgatcggggtgctgcaccgcgacgtgaagccggccaacgtgctgatctgcaccgacggccggtgcgtgctgaccgacttcggggtggccaagctccccaccgacgtgcagctcaccacgccggggatggtgctcggctcgccgcacttcatctcccccgagcgggccatgggccaggagttcggcccgccgagcgacctgttctccctcggcgtcacgctctacacggcggtggagggccggcccccgttcgacaggggcgacccgatcgagaccatgcacgccgtggtcgaggacccgccggccacgccgcagcgcagcggcccgctgacccgggtgctgatggggctgctggagaaggacccggcccgccgcctcgacgtgcacaccgcccgcgcgatgctccgcgagctgctcgccggcccgctgaccagcaccgccaccgccgtcaactcggtcaccgacccgtacgcggtggtgccggtcaagcagcgcccggccgtcgccccaccgccctccgctgcggagccgaagccgagcgggcagatcggcggccgggcgatgctcgcccccggcgagtcgctgaccgaccggctggcggccctgcgccggggcgagaagacgaggaagaggaagacgacgaccgccgccgcgctggacgacaccagcgccgacgcgcttgccggcccgctgcacacccccaccggggcgatgcccgcgcccccgcccgccggccggacgtacggcggttcgtcggaggccacccagcgggtcgacgcggggaccgcgccggaggccacccagcggatgacgtacggcagcccgcccgacgccacccagcgggtgtcccacgggagcggcccgtcggaggccacccagcgggtgccctacggcggcggctcggcggacgccacccagcaggtgcccttcggtcgccggcccgacgcgacgcagcgggtcccctacggcagccagcccggcgcgacgcagccggtccccggcttcggcgcgtcgccggacgccacccagcgggtcggcggggcgtacggcggcggccagtggtcggtgcccggcaccggccagccgtgggccaccccggccaccgcgcccgccccggccaccgccggcggcggcggggtcggccgcctcgtcgccacggtcaagggctggccgcgcaaggtgcagctcgccgcggccggcggcgtcgccgtgctgctgctgatcggcgtgttcgccctcttcggcggcgacgacccggagcagccgaccaccccgcaggggcagccgagcgccggggcgcccgccggccccggggtggagatgcaggagcagtcggccaagggcgtcacggtgcaggtgcccaagggctgggagcggcgcagtgccgacgggggcgtgtgggtcgactacatcgatccggaggacaacagccgcaaggtgcgcatcctcgccgagcggtggagcggcacgtcgacgcgctgggccgagaccgccgcgaacgggctgcggacccggtcggcctcctgccagaagccgtacaaccaggtgtcgatgaccgagcaggagctcgacggcaaggcggcggccgagttcgagtacacctgcggcgacggcgagggcaagcggcacggcgtgtggcgcggggtggtgcacgagggcaaggtctactcgttctacctctcctcgaccgacgcccgcttcgccgagagcaagccgatcttcgatcagatggtggcgtcgttcaagctccgcgggagcgactgagccgggccgggggccgacgcgacgccggccgggcgggccgacgcgacgtggtgagccgccgccgtgctatcaagagccatggcggcggacaccactgacctcgacgacacgcgcgatctggacgaccttcgcgaccgggcccggcggtggctcgacgacgaccccgacccggccacccgcgacgagctggaggccgtgctcgacgggctgccggcgagcgcggccgagctggccgaccggttcgccgggccactgaccttcggcaccgccgggctgcgcggcccgctgcgcgccggccccaacgggatgaacctcgccgtggtcacccaggccgccgccgggctcgtcgcctggctcgccgcccaggacgccaccgggccgctggtcatcgggtacgacgcccggcacggctcgcgggagttcgccgagcgcaccgcccaggtggccaccggcgcgggccgcccggcgctgctgctgccccgcccgctgcccacccccgtgctggcgtacgcggtgcggcagctcgacgcggcggccggcgtgatggtgaccgccagccacaacccgccccaggacaacggctacaaggtctacctcggcgcgcagctcggcggcgagctgggcgcgggggcgcagatcgtgccgccggccgacaccggcatcgaggccgccatccgggcggtcggcccgctggccgacgtaccgctgggcccggccgggcaggtcgtcggcgacgacgtggtcgtgtcgtacgtcgaccgggccgccgccgtggtcgacccggcggggccccggagcctgaaggtggcctacacgccgctgcacggcgtgggcgcggccgtgctgaccgccgccttcgcccgcgccggcttcggcatccccggcgtggtgcccgagcaggcggtgccggacccggacttccggaccgtcagcttccccaacccggaggagccgggggcggtggacctcctcgtcgcgctcgccgagcgcaccggggcggacctggcgatcgccaacgaccccgacgcggaccgctgcgcggtggccgtccgcgacggccgggcggcgggcccggcaccggtgagtgggggcgcctggcggatgctgcgcggggacgaggtgggggcgctgctcgccgaccatctcatgcgccgtggcgtccacggcctgtacgccaccaccatcgtgtcgtcgtccctgctacgggccatgtgcgccgcccgtggcctgccgtacgacgagacgctgaccggcttcaagtggatcgtccgggccggcggcggaccgctgggtgaggccggctccgacccgctggtcttcggctacgaggaggcgctgggctactgcgtcgccccggagcacgtccgcgacaaggacggcatcaccgccgcgctgaccgtcgccgagctggccgccgggctgaaggcgcaggggcgcaccctcaccgaccggctcgacgagctggccgccgagttcggcgtgcaccacaccgaccaactctcggtgcgggtggacgacctgcgcatcatcgccgacgcgatggcccgggtccgggcggccaccccgacgaccctgctcggccgcccggtgaccgaggcgcgggacctgctccccgaggcggacgtggtgatcctgcgtaccgacggggcacgggtggtgatccgcccgtcgggcaccgagccgaagctcaaggcgtacctggaggtggtggagccggtggcggacggcgacgtgccggcggcccggacgcgcgcggcggccacgctggcggcactccgcacggaaatcgccgccctggtgcagggatgaggtgtgctcccgcttccgacgctctctcagcgggttggcgtgtcgcccccaggttcgtggtgatatgcggccaggtaagccaccgtcctgccactatccatgtcgtagaacatgatgcgtgccacttggatgtagtagtaggtgaccaatgaggtgaacccggggccctgtttgagcgtgtacgtagcgccgaagccactggcagtcacatcgtcacggcgggctttcccgttagcgctcgcgtagctcagcgcagcaggaacatcctccccgccatagggatacagcagctggctggtgtatcccttctcgaagggctttgcaggttctgccggcaagggcgagaggtcctgggcgtccgtcttgatcacgatctcgtagagccggacatcggccgtctcggtgttgtacgccaggatgaccggcaccggcaaggtgtttgggagcgtgaccgaaatggacgtgaacccgggtccggggcgctgcgtcggccgctgcccggcttgggtggcgggcccgtccgaggaataactacggaacatgcaactgccgtctgtcttgttgtacaggaacagccactgccgctttccaccctcgccgttcacctcgaagggcgctacggacgaccatccagcgccccagttgtccttctggccatcaggcggccacacctgctcgcaaccgtcttcgttgtccacaacctgccacacggcgctgttgccggtaagggcatcgtagagctggacataccgcctgtcgttctgcacgacgggaacgacggaggtccaccccttcccgaaattgcgctgccagcggggaggccactcgggtggcatctcgtcgtgggcattgactggaccgaaggcggccgtgccgtcattgctgttgtagaacagcaccgctgggccactgtagtgcccgtcgaaatgcagagatatgacgtgcgtgaaccctggtccgagttggacatcatagagagcattccggagtgacatgggtttaccccgtcctagggatcactgcttctcaacaagatcatcaacggtgtgcggcaggctgcacaatcgggtggaagaagagccagcaccgggcctcactggccatcacagtatcgtctgacctcttcgaccgggcccgaaacgggcgaaccgagagcgttccgcgcatctgtcggtcgggcgtgtcgaaggtgcggctgttcgccacgtgcgcggcgagcagggtgccctccgcgccgtcacgggttctgccacgaggcggccaggacccagacggtgaccagccggcccagggtgccggtcacgatgaaccgcttgcgaccgctggctgcgccgctccggcggccctccgcgccggaccgggaacgcggcacgctcaccccgcgtgatcccttgcccacgaagggctcgtctgaatagcatcagcacatcaggccccaccattacccggcaccattggcattcgctttcttcgacgttgcggctgcggtgcccgggcgttgcatttccggcggaaaggtgttgcacggtgcgtgaaacaaatggctcgaccgtgccgcgacggcagctcggcaggctgctcacccagctccgcgagagcgcccatatcagcatcgacgcggcggccggcgagctggactgctcgcggcagaagctctggcggatcgagcgggggctgacctcggccaagacaccggacgtccgggtgctctgcgagctgtaccgggccacgcccgaccaggcgagcgtgctgctcgggctcgccgaggtgagccgggccgaggggtggtggcacgcccacggcagctccgtgccggcctggttctcgctctacgtcggcctggagaacgtcgcgagcagcattcggcactacaacgcggagctggtgccggggctgttgcagacccccggctacgccaccgcgctcttcgagcacaaccggcccgagctgggcgaggaggagcgaaagaaggcggtgggcttccggactcagcggcaggggctgctggcccggcggctgcccccggcccccgagctgaccgtgatcctcagcgaggcggtgctgcgccgcccggtgccgggccgatcggtgatggccgaccagctccggcacctgctggccgtcggcgaacggcacaacatcaccgtacgggtgctgccgctggccgccgggccgccgctggccgccgaggccggcacgttcgtgctgctcgacttcccgctctcggcgctcggcagcccgaccgagccgccgaccgtctacgtcgaggggctcaccggcgcgctctacctcgaccagccgacggagatcgccgcgtacgaacgggtctggaggggtctggattcgctcgccctcggcgcgcgacaatcagcggagctgatcgatgccatccggggagagtgctatgagtgatctgaccggcgcccgctggcgcaccagcacccgcagcggcaccaacggcggggactgcgtcgaggtggccgacaacctcaccggcatcgtcggcgtccgggacagcaaggacccgggcgggccggccctgaccgtcccgcccgccgcctggtccgccttcgtcaccgaggtcaaggccaaccgcctcacccgctgacagctccgcaacgaaccaacccccggctacgcctcagacgcggccagcgccccagggctgcccacgcctcagacagcccgcgcctcagacgtgcctgcgcctcagacagcccgggccgcaggggcgcgtgcgcctcagacggcccgggcctcaggcgcgcttgccgagggcggcgtcgaccgccttgcccagggcggtgacgaccagggccaccgaggggcggaccaccgagtcgtccaggctgacggtgccggagaagccggccccgcccgcgatctcctccagccgacgccgggcgtcgacggcggcgtcgccggtcaggccgagcgccggctccatccggagcaccgcgaccagggtggccagcgccgccgtcgcctcgtcggggatctgcccgccggccagcgcctcggccagccgccgccgggagtcctcctccacggtggcgtccgccgtcgggtagcggtgcacgtggatgaagcccagctcggtctcctcgacgtcgcgcaccacgccccgggcgaccaggtcgccgaggatccggtcgcgcaggccgtggcgcagccgctgcacccaggaggacggggtgtgcggcgtgtcggcggccatccggcccaggacctcgtccaggatcggttcgccggtgggcgcggggtccgtgaccaccaggttcccatcgacgtacgcgacccggccggcgagggccagctcgatcaggacggcggcggccatcccgaggtcgaggctgatccgcggcatggtcgccttgccggattcgtcgtcgtacgcgaggagcagcaattcctcggccagcgcaacaccagtcatggccggagacggtagcgcctgagcgcaccccgtgcgcccccaactcgcccacgagcgcactcgcccggtgagaggggaaccccgctataccgcaggcgttaacagggggcccttccttgcgatcagaagcggggcataccgccgaactggcggtcgccggcgtcgccgaggcccggcacgatgaacatccggtcgttgaggctctcgtcgatcgcggcggtgacgaggcgcagcggcaggccggactgctccagccgggcgatgccgacgggcgcggcgagcacgcagagcacggtgatgtcggtgcagccccgctcggccagcagccggcagcagtgctccagggagccgccggtggccagcatcgggtcgaggaccagcacgggcaggccggcgaggtcgcgcggcagcgactccatgtacgcgcgcggctcgtacgtctcctcgtcgcgggcgaggccgacgaagcccatggacgactcggggagcagggcgagcgcggcgtcggccatgccgagaccggcccgcagcacgggtaccagcagcggcgggttggccagccgggtgccctcggcgtcggtgacgggggtctgcaccgggtacttctcgacggggaaggagcgggcggcctcgtacacgagcatggtggtgagctcgtgcagcgcggcccggaagttggaggagtcggtgcgcgcgtcccgcatggcggtcagccgcgactgggcgagcggatggtcaatgacgtgtacgtccacgatcgcccaacctaccgaacgcccgggccccgagacacgaggagcgacgccgctcacccggcccgtgcggcaaccctggacggttggcgttcgaaggtagggcaggtgcccaaggtcgggcccgacctcgccgcgtgatcaagatcacgaggcgtgcgggtgcgtagacttccgggcatgacggcgacagcgacgtcggcccggtcggacctctccgagctgggacgatccgagaccgctttgcggaacttcctgcacggcctgccgggcgtggaccaggtcggcgcggagcagcgggcggcccagctcggcacccgctcgatcaagaccacggccaaggcccgggcgatcgacctggcgatccggatggtcgacctgaccaccctggagggggccgacacccccggcaaggtgcgggcgctcgcggccaaagcactgcgccccgacccggccgacccgtcctgcccgcacgtcggcgcagtctgcgtctacccggcgatggtcccgtacgtggccgaggtgctgcgcggatccgccgggtccgggcggccgtccggcggaccggacggcaacgcgccggccggacccggcgtggtgcacctggccagcgtggccaccgcgtttccgtccgggcaggcacccctggaggtcaagctcgccgacacccgggccgcagtggcggctggcgcggacgagatcgacatggtgatcaaccggggcgcgttcctggccggccgctaccgcgaggtctacgacgagatcgtggccaccaaacaggcgtgcggggacgcccacctcaaggtgatcctggaaaccggcgagctggccacgtacgacaacgtgcgccgggcgtcctggctggccatgctggccggcggcgacttcatcaagacctcgacgggcaaggttcccgtcgcggcgaccctcccggtgacgctggtgatgctggaggcggtccgcgacttccgcgccgccaccgggcggcaggtcggcgtgaagccggccggcggcatcaagaacaccaaggacgcgatcaagtacctggttatggtcaacgagaccgtcggcccggactggctggacccggactggttccggttcggcgcgtccagcctgctcaacgacctgctcatgcagcgcaccaagctgacgaccggcgtctactccggtcccgactacttcaccctggactgagcgtgatcttcgaatacgcgcccgcccccgagtcccgctcggtggtggacctcaagccctcgtacgggctgttcgtcgacggggagttcgtcgacccggccgacggcggcggcttcaagtcggtcaaccccgcctccgaggaggtgctcgccgagatcgccgaggcgggcagcgccgacgtggaccgggcggtccgcgccgcccggacggcgtacgagaaggtgtggggcccgatgccgggccgggaccgggccaagtacctgttccggatcgcccggatcatccaggagcgctcccgcgagctggccgtgctggagtccctggacaacggcaaaccgatccgggagtcccgggacgtcgacctgccgctggtcgccgcgcacttcttctactacgcgggctgggcagacaagctgccgtacgcgggcttcggcccgaacccccggccgctcggcgtggccgcgcaggtcatcccgtggaacttcccgctgctcatgctcgcctggaagatcgccccggcgctggccgccggcaacacggtggtgctcaagccggcggagaccaccccgctgaccgcgctgctgttcgccgagatctgccagcaggccgagctgccggccggcgtggtcaacatcgtcaccggcgcgggcgacaccggccgggcgctggtcgagcacccgggcgtggacaaggtcgcgttcaccggctcgaccgaggtcggcaaggccatcgcccggtccgtcgcgggcaccggcaagaaggtcaccctggagctgggcggcaaggccgcgaacatcgtcttcgacgacgccccggtcgaccaggcggtcgaggggatcgtcaacggcatcttcttcaaccaggggcacgtctgctgcgccgggtcgcggctgctggtccaggagtcggtcgccgagcaggtgctggagtcgctgaagcgccgaatggcgctgctgcgggtcggcgacccgttggacaagaacaccgacatcggggcgatcaactcggccgcccagctcgcccgcatccgcgagctgtccgccgcgggcgaggccgagggggcggagcgctggtcgccgccgtgcgagctgcccgagcgcgggttctggttcgcgccgacgatcttcacgggggtcacccaggcgcaccggatcgcccgggaggagatcttcggtccggtgctgtccgtgctgaccttccgcaccccggccgaggccgtcgagaaggccaacaacacgccgtacgggctgtcggccgggatctggaccgacaagggctcccggatcctgtggatggccgaccggctgcgcgccggggtggtgtgggccaacacgttcaacaagttcgacccgacctcgccgttcggcgggtacaaggagtcgggctacggtcgcgagggcggccggcacgggctggaggggtacctcggtgtctgagcgggtcgcggtacgcaagacgtacaagctcttcatcggcgggaagttcccgcgcagcgagtcgggacggtcgtatctcgtgcaatccgcgaacgtgtcgctggcctcccgcaaggacgcgcgggacgccgtggtcgccgcccgcgccgccgtgaagggctgggccggggcgaccgcgtacaaccggggtcagatcctctaccgggtcgccgagatgctggagggccgccgcgagcagttcgtcgcgctcggcgtgccggccgacgaggtcgacgcggcgatcgaccgctgggtctggtacgcgggctggtccgacaagctcccccaggtgtacggcggtgcgaaccctgtcgccgggccgtacttcaacctgtccgcgcccgagccgacgggggtggtggccgtggtggcccccgaggcccccgcgctgctcggcctggtcagcgtgatcgccccggcgatcgtcaccggcaacacggtggtggtggcggcctcgccgacccagcccctggcctcggtgaccctggccgaggtgctggccacctccgacctgcccggcggggtggtcaacgtcctgaccggtgcgatcaccgagacggtgccgacgctcgcggcgcacctggacgtcaacgcgatcgacctgaccggggtgggcgacgcgtcgctcgccaccgagctggaggtcagggcggcggagaacctcaagcgggtgattcggccggccccggccgaccacgactggtacgccgacccgggcctcacccggatgacgacgctgctggagacgaagacggtctggcaccccaagggcgtctgagcccaccgacccgtccaccgacccgcccgccacccggccgccggaggcaggggtgggcggcgggtggggtggatctactacgaggggtaggattgccgcgtgactcggttgggtgatcttgagcgggcggtgatggacgtgctgtgggacaccgtcccgggcacgtcggacggggtgacggtgcgcgaggtcgccgaggccctcgacggccgcgagctggcgtacacgacggtgatgaccgtgctggaccggctcgccggcaagggcatggtgcggcgccagcgggaggggcgggcctggcgctaccaggccgcggccagccgcgaggcgcacatcgcccagctcatgctcgacgcgctggacctcggcggcagccgggacgccgcgctggtgcgcttcgcccggtcggtgaccggcaccgaggccgaggtgctgcgcgccgccctcggcgccgaggcgggcggcccgctgaccgaccgcgtcgacgcgccgcgcgccgaccgggccgggcagccggccctggccgacgaggcgacggaccggtagggccgccgtcatggcgtacgccgtgcacttcgccgcgacggtcctggcctgctacctgaccgctcaggtcctggcggcgtccacctggacgtggcgggccccccggatcgcgatcgtctgctggcaggcggtcgggctcgcgctcgggctctccgcgatgggcctgccgatggcgctcggcgtggccgcgtacgaccggccgaccggcagcgcgttgctcgccctggccaccgacctgacccacggcaccctgccggccgggctcggcgcggtccacctcggtctggtcggggtcgggttcggcatcggggcggcgctgctcgccacgacggtacgcagcgtgcaggcgaccgtccgggcccagcggcagcaccgggacctgctcgccctggtggcccggcgggacccggaggtgccgggggcgctggtgctggaccatccgagcgcggcggcgtactgcctgccgggcgtgcggccccgggtggtggtcagcgccggggcgctcagcatgctcgaccgggccgagctggcggcggtgctgacccacgagcgggcgcacgcccaggagcgccacgaccttgtgctgctgccgttcaccgcgctgtgccgtgcgctgccctggttccgttgggtacgcgacgcgcacgagcgggtcgccctgctggtcgagatgcgcgccgacgacaaggcccgggagctgcacgccgaggctcccctcgcgggggcgttgcgccggttcgccgcggccggccaccggatcgcgccggccggcaccctcggcctgggcgaccgggacctggacgtccgggtccagcggctgctggtcgccgaccggccgccccggctgatcggggccgccgcgctggcggtggcggtcaccctggtcgcgctgccggtctccctcttcctgagctgacgcccgacccggacacgtccgacccggacacgcgcgaccggacacgtccgacccggacgcctcgcccgagttgggcccgtgtcccacggggccggctcgcctgcccgttgccgggccaccgacatgcggggcgataggtagagagcctacgtgtagtcttcctacgacaagggagcctactaccggagggcggccatggatcaactgctcctcgcccgtctccagttcgccacgaccacctcgctgcacttcctcttcgtcgtcgtcacgctcggtctggtcaccctgctcgtcgggctccagacggcctggacgatcaccggcaatcccgtccacgagcggctgacccggttctggggtcagctctacgtgatcaactacgtgctcggcatcgccaccggcctgctcatggagttccagttcgggctgaactggagcggcctgtcgcgctacgtcggcaacgtcttcggcgccccgctggcgatcgagaccctggtcgcgttcttcctggagtccacgttcctcgggatgtggatcttcggctggcaccggctgcgccggggcgtgcacctcgcgctgctgtggggcgtggcgctgaccgcgtacgcctcggcgttctgggtcatggtggcgaacgcctggctgcagaacccggtcggctacgaggtgcgcgacggggtggcccacctgaccgacttcggcgcgttgctgaccaatcccaccttcggcctggccttcgggcacgtggtcgccgccgccctgctcaccggcgggatgctgatggcggcggtgagcgcctggcacctgatccggcgcaccccggaccacgcgctgttccgcacgtcgctgcggatcggcctggtcaccgcggcggtctcgatcagcctggtgcagggcttcggcttcgcccagttcgggccggtcgggcagacgcagcccaccaagttcggcggcggcgcgcagcgcgacgccctggtcgccgaatggacctcccggttcgggcccggcgactacaccccgcccgtgctggccgacgtcgggctcggtttcatgatcctgatcggcctcctcctgggctgtctgtggctgctgctccccctgctctggcgggactggttcatccggctgcgcttcccgctctggctgatcctgctggcgctgccgctgcccttcgtcgcggtgatcctcggctggatcgcccgtgaggtgggccgccagccctgggtcgcgtacgggctgctttccaccgagcgggcggtctcgccggtcgcgcccggggtgatgctcgcctcgctgatcggcttcaccctgctgctcggcgggctcgccgtcgccaactgggtgctgttcgcccggtacgccgcccggggagccgccgatcccgccctaggccgccggcccggcccagccgccgacgagtcccgtcccgtccccgtcctcggctgaggaggcccctgtggaactcgcctggtacgccctgctcgggctcttcctcgccggctacctggtcctcggcggctacgactacggcgtcggcctgctgctcgcccggggcggcccgccggcccgccgccgggcggccctcaccgccgtgggcccgttcttcctcggcaacgaggtctggctggtggcgaccgtcggcattctgttcggcgcgttccccaccctggagggggaactgctgtccggcttctaccccgtcgtcgccgccgcgctggccggggtgatcatggtgaccgtcggcgtgcaactgcgcagccgcccgaccgacgagccgacccgcgccgcctgggaccggatggtggccgccgggagcctgctcgccgcgttcggctggggggcgctgctcgccgggctgctccagggcgtaccgctggccgccgacgggcacgtcacgggcgtcggccacgtggccaccccgttcgcggccctcgccgggctggcgatgacggccctggtggcggtgcacggtgcgacgttcctcacgctccggctgtcggccgccgacgccgcaccgctggcccgtaccgcccgccggctggtcgcggtggcgctcgccgccgtcgccctggccgccgtcgcgggcgcgctctccgatcgggtacgcgccgcgacgcagcgcccgctgccggccgtactgctgccgttggtactggtggcggcgctgctggtggcccgggcggcgcacgcgcggcacctgcccggggtggccttcgccgccacttcggcggcgctggcgctgccggtggcgggagtcggcgcggcgttgtggccctacgcgctggtctccaccgtcgcaccgacggcatcactgagcgtgaccgacgcggcggccagcgggccgacgctgacggtgctgggctggctggcgctaccgctcctgccggccctactaggcttccaggcgatgtgctggtgggtgttccggggacgaaccgacggcagggcaccggtgtactggtgagccgccgtcccttcgacccacgtctgctccgccgggtccccgcggcccggcgcgacctcgccgtgctcgcggtgctcggcgggctgacggcgctgctggtcgtggggcaggccaccgcgctggccacggtgctggccgccgcgctcgacgggcggttggcccggccggcgctcgccggtttcctggccgccgtggtggggcgggcgctggtcgcctgggcccagggcacggtggcggcgcgggccgccgcgacggtcaaggcggcgctgcgggccgacctgctcgccgccgtcggccggcacggtcccggctgggtcgccgggcagcgggccgggcagctcgccaccctggccgggcgggggctggacgccctggacgcctacttcaccgggtaccttccgcagctcgtgctcagcgtcaccgtcccggtggccgtgctggcccggatcaccttcgccgactggggctcggccgtcatcgtcgcgctgaccctgccgctgatcccggtcttcggggcgctgctcggctggcaggcgcaggccgccaccgagcggcagtggcggcggctgtcgacgctcggcgggcacttcctcgacatggtcgccggcctgcccacgctgcgcgcgttcggccgggcccggggccaggtcgaggtggtccgccggatggccgacgggcaccgcgccgcgacgatgcgcacgctgcggatcgcgttcctgtccgcgctggtgctggagctggtcgccaccctgtcggtggcgctggtcgcggtgccggtgggcatccggctgctcggcggcgggctggcgctgtccaccgcgctgctggtgctgctgctcaccccggaggcgtacctgccgctgcgggcggccggcagccggttccacgccagcatggaggggctggccgcgctggacgaggcactgaccctctccgccgccgacccgaccgccacggccaccgccgggtcgcggcccgtccccgacgggcgcgccgagatccggttcgagggcgtgaccgtcgcgtacgagcggaccgtggcgctacgggacgtcacgctgacaatccggcccggcgagcggatcgcgatcgtcgggccgagcggcgcgggcaagagcaccctgctcaacctgctgctcggcttcgtcgccccgacgcagggccgggtcaccgtgggtggcgtcgacctggccggcgcggacccggacggctggcggcgtcaggtcgcctgggtgccgcaacgggcccacctcttcgccgcctcgctgaccgacaacatccggctcggtgcccccggcacgcccgacgccgcgctcgccggcgcggtcgccgccgccgcgctggacgaggtggtcgccgccctgcccgacgggctcgacaccgtgctcggtgagcgcgggcacggcctgtccagcggccagcggcagcgggtcgccctggcccgggcgttcctgcgggacgcgccggtggtgctgctggacgagccgaccgcgcggctggacaccgccagcgaggccggggtgctggccgccacccgccggctcgtcgccgggcgaaccgccctgttggtggcccaccggccggcgctgctctccgacgccgaccggatcctgcgggtcgaggaaggccgggtcaccgagctgaccaccaccccggccacaggggtgacccccggccccggcgaggcggctgccggaccggccgggcaggtcgcccccgccccggccggagagggggcggcccgatgagcaccggtcccgccgacgacgccttcgccatcccgctgccggccgacggggccccggtggccggcggcagcgtccgggccgccgagcgggccgtgctccggctggcccggccgtacctgggccggctggtcggcgcgggtctgctcgccgccgccaccgagttcgccgggctggccctgatggccaccgccacctggctgctgatgagcgccgccggtcggccaccactggaccggctcaccgtggcgatcgtcgcggtccgggcgctggcgatcagccgaggcgtgttccgctacaccgagcgcctcgccggccacgatgccgtgctgcggatgatcaccgacgtccgggccggggtcttcgccgccctggccgcccggcgcgacgccgcccggcagcgcaccggggacgcgctgagccggctcgtgtccgacgtggaggccgtgcaggacctgctgctgcgggtgctcgtcccgggggccgccgccacggtggtcagcgtgctggccgtggccggggccaccaccatctcgctccccgccgccggggtgctggcgctgggcctgctcgtcgccggggtggccctgccgctcgcggccaccgcgctgacccggcacgccgccgaccgggtggccccgctgcgcggcgcgctcgccacggacgccgtggaccttgtccacggcgccgccgacctggccgcgttcggtgccaccgggtacgcgctggacgccgccgccgatcgggcccgccggctggcccggctggaacgacggctcgccgccaccggcttcgccgtggacgccgccggggcgctcgtcgccggggtgaccgccggcacggtggtggtcaccgcgctgcgcgacggcgtcggcggggtgctggtcggggtgctggcggtcggttccctggccgccgtcgaggtggcgctggcgctggtcggggccgcccggcagcgcacccagctccgggccgggctggtccgggtggccgccctgctgaccgccccgcaggccgacgcgcccgccgccaccccgcccggtgccgcccgtgccgccgccgtcggtgccggcccgcacgacgtgcgcttcgacgcggtcaccgtgcggtaccgggccggcaccgccccggccctggaccgggtcaccctggacctgccggccggccgccgggtcgccgtggtcgggccgagcggcgccggcaagagcaccctcgccgccgtcctcaccggcacggtgcgacccgagcagggccgggtcaccctcgacggggccgacctgtcggcgtacccggtcgaggaactgccccgggccgtcggcggcctgctcgccgaggcgtacgtcttccacgccacggtccgggagaacctgctgctcggccggcccgccgccgacgaggcggagctgaccgccgcgacccgggcggccggcctgctggactgggtgcacgcccagccggccgggtgggacaccgtggtcggcgaggagggcggacagctctccggcggccagcggcagcgcctcgcgctggcccgggcgctgctcgccgcgcccggggtgctggtgctcgacgagccgaccgaggggctcgacccgtccgccgccgacgcggtgctcgcctcggcgctggcggcgacccccgccgggcactcggtgctgctgatcagccaccggctcagcgggctcgccgacctcgacgagatcgtggtgctcgacgccggccgggtggtccagcgtggccggcacgacgagttggtcgccgcgccgggctggtaccgggaccagtggctgctccaggaggcggccgagcgcgggtacctggccctgacgccccgcccctgagccggctccgggattcccccggacgcgtcggcagtcaccgcatggcaggctcgtcgcatggtgcgctgcgacgacgtactcgtgaaggagcggctgcgcgagttgagcgaccggctgcacggcccggcacggctcaaggccgacctgctggccgaggcccgccacgcgttgcaggacgccgtcgaggcgtaccgggacggcgggctgccggcggcggaggccgagcggcgggcagtggccgagttcggcgagccggcccggctcgccccggcgtaccaggcggagctggcggccgggtcgctgcgcggcctgtccctgcgggtgctcgcggtcgccggcgtcctggtcgtcgcgggcgatctgacctggcaggggtcgagctggagcggcggccccggcccgccggcggcctaccgcctgctgtccgcctcggtggacggcatctggctgggcgcggtcgtgctgtcggtggcggggttgctgctggtcgccgcctcggcccggtgggcgcacccggccctgccccggctcgcccggctgaccggtctcgggctcaccgccacgctcgtcctgggcgtggcgaccggcgcggccctgtacgcctggtcgatcgggctctgggaggcggcccgcacctggccgccgatgctcgtgggcgcgctggtctgcggcgcggggttcttctggatcggtcgggcggcccggtcctggctgctctcggcacgccgaccggccggaccggcgtagtcgggtgggcggcgggcgcggtcaggccggcgtggcgggggtgtcgccgaggaactggccgacggtcgcgctgaactcccgccagccggcccgttccccggcgagggcccggcggccggagtcggtcagctcgtaggtgcggcgctcgcggccgttgacggtgctccaactgctgaccacgtgccccgcccgctccagccggcgcagcgccgggtagatcgtcccggtaggcagatcgaggctgccctcgctgcgcgcgcgcagcgcctcgatgatggcgtagccgtgcagcgcgccccgttccagcaccgcgagcagcagcgcgtcgaggtgtccgtgcagcgcctgggccttcataggtagcaagactacttgtgggccactcgcgccgccaccggggtgcgggcaccgggcctcctaagccgcccactagggtatgtgcccagagtcactcggcggccggagacgccgccgggtgggcagcccgaagcacacggaggtcagcgtggcccgccagtcgccccaacggcccgacgccgacgagcctgagctcgacgagaccgacggcaccgccgcagaggtcgaagaggacggcgcgcgcccgtcggcgcaggacgccgaccgcgcgctctgggacgagctgcgcatcgacccggtcgagatcgccctgcccgccggcaccggctacacgctgcgggcgtaccggccggcacgggagttgaccccgaccgacgtcgccgagcgcgaccaggacgacccgttcctggcccgccggcaggcggtcgagaccgacgaggacgaggacgaggtcatcatcctcgacgaggaggtggccgccgagttcgccgaggcggacgcggaggaggccggcgggaagtcccgctcccgcaagccccgcgccgacgcggactccgacgacgccggagccgccacagacgcggacgcggaggaggagccggactccgacgaggacgaggcgggcgacgaggaggttccggtcttcctcagccaccggggcaggctgctgctgttcaagacgcccgaatccctcgtcagcttcgtccggtccggcgcacccaacgacatgtctcaactggacagctggaatgaactgtccgaacgggtggagccggccgacatcgtcccgctcgacgaggacacctacgagctggacctggtcgtggagaacctgcggggtgggcacgacacctgggactcggcgctgctgatcgagccggcgaggtggcccgggacgtcgcgtatgccctgcgtctgcccgccgtgttggacatgctctccgccggctccagcctcgacgacctggacgaggcgctgcgcgccacggccaacggcgggctcgggggcttcctcggccgccggcggctgaggaaaatcggcgcgcagacggcgagtctcggttggcgcaccattgtcggcaagatctctgcggtcgtggactggcgcgactgacacgttccagggagcatcagtctctggcagagaaagaccagtcccgggaggaggacgacgctgtggcgctcgtgcgcgtgtactgcggtctggcctcggcggatccggccgaccgaccggcctcggccggttcggcgctgacgtccgctgtggtcgacgacgcaggtcggctgctccatgtctgcgagatcggcgacgacccagccggctacgctcagctggtcgtgctactcgtggagcggtcgggcgggccgagcggggctgcgatcgccgccgacagcgacgaccacacggtcacctcgctgctgagtgccgccgggcgtccactggcgatcgcggacgacgactcggtggacgacttcgccgagcggttcgccgacgacgactcgctggaggagatgcagtccgcgccggccgagcggcgggcggtcgggctggcccgggcgctccaggccggcgcgctctcggcggtcaccctcccggcgccccgggatctcgccggctacaagcaggtcctctcggcgcacgccgcgctcgccagcggccggcactccgccgccgtggcgctgcgcgaggtgctgcgggagctctacccggccgccctgcgcgcgtacccggacccggccgagccggtcgccctggccgtgttggacgccctgcccgagcccggcatgctgggcgggacgatcgcccggggccgggaggtgtcggtggcggcggacgccatcgccgcccacctcgcggccgacggggtggccgacgaaggcaagatcaacgatgcggtgaccgcgctgcgggtcgccatcgccgagaccccccgccgcgcggcggtcagccgggcgctcacctccgccgtggcggagacggtccgtcaggcggtggcctcggtgcgagcatgcgacgcgggctgcgaggccctggtcggcgcgctcgacgcccgggtcaccacccccaccccggtgccgggccggcgggccgccgcccgccggggcgagccggtcgccgagttgcccggcgccggcctgcgcgcactgcggcccacagagcccgagccggtccccggccggcgcagccgtcccgagccggtccccggcggcagcctgcccgcccagccccgcccgctcggcccgccgccggtcgcgccggagcccgtcgccccgccgccggtcgccccgcgcccgatcaccccggccgcctcggccaccccgccggtctccggcccgccgtcgcccgagccgcgccgcctgatcgacaacccggccaaccggccggtctccgcgccgccgcccccgccaccggggatcaccccgatcgcgccgagccagcgcgagcgcgggtccgtgccgccggccgaggccggtgagccgttccggcccacgctgaccaccgccgcgatccagaacgcgcgggcggagcggcagcgcaccatcatcccgcctcgccccaagacgacgggcgagtccgcgccgccgcccaccggcggcttcagcgccaccgacctgagcgtcccggtgccgaccccgcgtcccggccaggagtccgctccccccggctcgcgggcgaactggccgctggtcaacaaccccgaggaccccgccgacagctccccgaacaatcccgtcgcgcggcggcccttggaggatcgggcgaagcggcagatcgacgcgccgacccaggtggtcccgccggccgagggccgggtcaccccgccctggctcgccgacgacctgccccaggagccaccgatgctgcggctggtcgagccgccaccgctggccgaccgggcactgcgggatgggccgggccaggctgccgacccgcgcctggagcccccgccgctgcggctggtcgaccgcggcgaggcagcccgcgccggccgtcccgcgccggagccccgccccgagcgggcccccgcggaacaccggtccccgctgggtcagcgggtcccgttggaggagcggcccgacatggaacatcggaccgccccgccgcagccgtcgcggtccgcgccgatggagcggcgtaccccgccgatctccgacgagggggacggcgacctgctgatcttcgccgccgccaagtcggcctggttcgtcgggcacggcgacgagtccgagatggactggtcgagcaccgccgacaccgggtggcaggccgccgagcaggccgcccgcccggcggtgggcgccgataccaaggccgggttgcccaagcgggtgccgcaggccaacctggttccgggctcccccctgcgcgaggagcgtcccctacggatagtccgcgacgcggccagcctcgccgagaacacgaccggctacttccggggctggcgtcgcgggcaggagatcggcgggttcgccgtcggcggccggccgggccgcgaggcggccggcggctgggacttcacccgggacaccggcgaccgagacgacgaccgggagtacgagtaccggtccgccggctaccgctcctgaccatcgcgccggggtggcgggcaccgccgccccggccgcgcccgccgtgctggcgtacggccgtagcaacccgacgcccacccgaccgaccggtgggaccacaccgaagagcaaccctggccggccgcctgacgtcccgcagggacggtgacggctactggccgtccccccgggaaggttgcgaggcggtcggggcgcacaggcgctgtcagggccgctcctgagccgccctacggaatgggctagccctacggaatcgagcgccggccgcccgccggtggcgtcgagttcgcctccagccggtccccaaacagccggacgcgcccgacggcccggcgggtgccggtcgtcgggcgcgtcccgtcgtcgatcaggccggcgcgaccgcgcgcgagcggcgcatcgtgagcacgtactcgaccagcgagatcagcacgtgcttcgtcgactcccggttccgggcgtcgcaggccaccaccggcacgtcgtgcgagatcgcgagcgcgtcccggacgtcctgcgggtcgtggtactgcatcccgtcgaagcagttgatggccaccaggtacggcagccgccgatgctcgaagaagtcgatggccgcgaagcagtcggccagccgccgggtgtcgaccaggaccaccgcgccgatggcgccccggaccagctcgtcccacatgaaccagaaccgggtctggccgggggtgccgaacaggtacaggatcaggtcccggtcgatcgagatacggccgaagtccatcgccaccgtggtcgtcgtctcgcccggcacctgccgggtgtcgtcgacgcccacgccggcggaggtcatgatcgcctcggtggtcagcggcgtgatctccgagaccgagccgaccagcgtcgtcttgccgacgccgaacccaccggcgataacgatcttcgccgacgtcacgcgcccgctcgggacaggcgggcggtgcgacatgtcagagcctgcgaagtccactcagcaccctctccagcagttcagtgcccaccgcgtcgtcggagtcgtccaggatggtcggctcgtggactgcgaccaggccgtccgtcgccatgtcggcgatgagcaccctagccacgccgagcgggagctgcatccgcgccgcgatctcggcaagcgactgcacgcgtccgtcgcacagcgcggcgatgtactggtgctctcggccctggccaccgttgctactggcagcggcccgaccgcgcaccgtcgtctcgacgagcgcctccaacgcgatgtccagccgagggcgggtacgaccgcgggtgacggcgtacggacggaccaacgcgccagtcggctcgtcacgatccatgtcgccgctcacctccttcgtccccgacaccggctgaacccggtggaacccgtcgttcttgtccttgccaccccgcccgacccatcggccagcgcgtgggtcagcccatcatccccacagtcgtacgcggctgcggggtcaacgcgtcgcccacccggtcgaccaggagggccatctcgtatccgacctgcccgacgtcgcagctacgggcggcgagcacggcgaaggacgagccgtccgagatggacatcaggaacaggaagccgttgtccatctcgaccacggtctgcagcaccgcaccgccctcgaagcagcgtgccgctccctgcgtgaggctgaccagcccggacgcgatcgcggcgagctggtcggcccggtcacgcggaaggtctcgtgacgacgccaggagcagaccgtccgcggagacggcgaccgcgtgcgcgacaccgggcacccggtcggcgaagttggccagcagccaaccgagatcctgcgtagttgtcatccttgttgctccttctgcccgctcccggccaccgggcctgagccagactgcgaggattgctgcccacccggagctgcctccgggttggtcgggttgccgtcgggctcggtacgcccacgctgcacgcctcgatggtatgccgagagcagaccgcggacgccctccggcgtacggcgctggaccgacgtggtgggcttctccaccccgccaggcacgagttgggccatcggcacccgcttcggcaggcccttgcgggtggtctccgccaccgggacctcggtggccgccgaggcggcccgccagccgtcgtccgcggcagtctgccaggcgtgggcctgcggcgtgggccgccggccggcgaagccctcggcgggaccggggcgggtgccaccgttggtcggcgacccgttgtcgcgcggcattcctccggccatcggggtgtctgccatcggtgcgttacctgtcgtcccgggtgctggtgtctggacgggccggccggtgacgtcgaccgcggagaactgttgggtcacggcggcgttcgccgggctcccggcgccattggtcgcgcgctgggcgacgccggccgtctcctccgaacccgagcggcgggtacggaaccaggccgactcgagctcccggaagatcggcagctccatcgtctcgtccgcgtaccgctgctgccggttctgggcctgcacgggcgtcgaccgcgccggcgtgggcggggtcgtcggctgggtggccggcgtgctcggcacctcggtgctcggcacccggggcagctccgtggtcatgtccagggctgcggcgaggcgctccggcaccggcggggtgaccggctccggcgcggccaccggcggccaggccggcggcgccacgggcgcctgggccgacgggaccggccgactgggcagcggctgcgccgagtacggctgaccggacacgggcgtgccgaacggctgaccggagacgggcgtgccgaacggctgaccggacaccggggcggccgagacgggctgacccgagaccgggaagacggaaaccggcggtgcggacaccggcggcaccgagaccggtggcggggtccagccccgggcctccgggctgctcggcagctgtcgggggatggccggctgctggccgctgctggccggatcgccgtcgccggacgcccgccgctgcggcagcgggtcgctcgactggccattcgaggtgcggccggcggcggcaccgccagcggtgccactggccccggtcaggtccgaccaggccggcatcgaccgcatggaaccggtcgacgcgggcgtgccgtggccgttgcgcgaggccgggtcgaacgaccggccgcccagggttacctggttgcccgagtgccccggccgctgggtgggcgccggtgtcgccgggttgttgccgaaggccgcgaaggcacccagggccgggggggccccgccgggctgcgagctggtgagcgaggcgggaggggccggcagcgcgccgggctgctggaaccggccggagagcgcccggggcaccagcacggtggtgggcagggtgacgtcggcgacggtcccccggtcggtgccgggccgcagctcgaccttgaccccgtgccgggacgccaaccgggcgaccacaaccaggcccatcatccgggagacggccacgtccacctgcggcggcgaggcgaggcggtcgttgaggtcgtgtagctgctcggcgctgatgccgatgccccggtcctcgacgtagaggttggcccggtcgccgacccggcgggcctccaccatcacctgcgagtcgggcggcgagaaggcggtcgcgttgtcgaacagctcggcgaccaggtggaccaggtcgttgaccgcgtgcgcggcgacctcgatgtcacggtcgatcaccccgaactcgatccgggtgtagtgctcgacctcggactgggcggcccgcagcacgtcgatcagtgccgccggctcgcgctgcacgcgggtggagtcggccccggcgagcaccagcaggttctcgtcgttgcggcgcatccgggtggccaggtggtcgagctggaacagctcggccagccggtccgggtcctcctcgccgcgctccagccggtcgaggtggccgatcagccggtcgaccaggatctgcgaacggcgggccaggttgacgaacatggtcgcgacggaggcgcgcagcgcggcctgctccgccgccgtccgtacggcctccaggtggaccgcgttgaacgcctcggtcacctggccgaactcgtccttgctgcgcaccggcagcggctcggcgatctggttggccgcctgcaccggggagagctggctggaaaactgcggatcgcgcagccgggcaacggcctggggcaaaccgtactgggcgatgctgagcgcaccctggcgcaggtcgcgcagcgagcgggccatcgaccgggcgaccaggtacgcgaacaggatggccagcagcagcatgccgagcagcaggccggtctggaggaacaccgtgcgctgtacgtcggagcggagcgcgtcggcctgcttgaccacgttgccgtcgagcttcgcctcgaccgtacggatcagtttggcgctggcgaccatggccgcgtcccactgatccggcccgaacggcgcgttggccatgctgccgttggtgttgccgtcgagccagccggtgtagttctgcgcctcgcgccggtcgccgccggcgacggtctggtcgtgcaggtccgactcgtccaggctggccaccgccttgaagctttgcagtgcctgctgctggccggtgccgctggcgatgtagtcggtgcgcaggatgggggtcaactcgcgctggatcagcgcccggtgcaccacgacccggcggaccgagaggtattccttctcccgggcgacggctgccgcggcccgcatccggtcgctcaggtcgttgtcaccggcgaggtgggtggcggagtcgcggatggacagcaggtcgttgatcaggccctcgtacgcctgcatggcgtcgatgatcttcaacttgccgttgaagacctggctgcgggtgccggggaggtccttcaggttctggtcgatcccgtcgaggaggccctccaggctgctcggcaggccgtcgacctccccccgctgttgcaggtacggcaccttgtcctggtcgacccggatgttgacccggttgtacgcctcctggtactgcgccttggcctggtcgccgctcgccccgagcagcaacaccgcggaggtgcgttcgtcctggaggctgttgaccaggtcgcccgagtagcccaccagattggccaggtcgccggagcggttggcgttgttcagcgtttccaggttgtcgacgaggccactggtgccgacgacgaccgtggcgatggtcggcacgatcatgatgagaccgagcttggaccagatcggcatgtcgcggagccggccgaccggccgacgcagtcgcgacaggaaggaacccgccgtcttcggtcgtttgctcacgtcaccgccctcgcgatcacagcgttcgcgcgttgccccgggcaacgctcagcgaccgacccggcgggtcggacctccgagattccatcacgccgtgttccaaagagaaagcccaggctggccgtcgccggaggtgtgatgagatgttgatgcaatttgctcgcaatccgtccagccggagtgactgacagtaatggatcacccccaccgcctcgtcctgctcgccggcccttcgggctccggaaagtcgtacatagcccaacaaaccgggcttcctgttctttgtctggacgacttctacaaggatggtgatgaccctacgttaccgcgccaaaacggtcttgtggactgggactcaccccagtcgtgggacgccggggcggccgtggaaacgattgcccggctggcgcgggacggcaaggccgaagtgccggtttatgcgatcggcgcggaccggcgggtggccacccggacattcgaggtcgccggatcgccacttttcgtcgccgaagggattttcgccgccgagatcgtcgaggaatgccgacggcgagggctgctcgccggggcgtacgcgctgcgccggccgcgcggcaccacctttttccggcggctcgcccgcgacctggccgagcagcgcaaggctcccgggatgctgctgcggcgcggcctggccctgctgcgcgcggagccggcggtgctgcgccgccaggcggggctcggcgctcacccggccccggcccgcgaggtgctgcgccgggtggccgacctgctcgccggccacccgcaccacccctgatcagcccagcagcttcccgtacgccggcttgatcacctcgtcgatgatggccagccgctcgtcgaacgggatgaacgcgctcttcatcgcgttgatggtgaaccattggagctccttccagccgtagccgaaggcctccgccagcagcgccatctcccgggacatcgaggtgccgctcatcagccggttgtcggtgttcaccgtcacccggaaccgcagatcgcgcagaagcccgatcgggtgctcggcgatcgacgccgccgcgccggtctgcacgttcgacgacgggcacagctccagcgggatccgcttgtcccgcacgtacgcggccagccggcccagcacgggcgggtcgccgggggtgatgtcgtccacgatgcgcaccccgtggccgaggcggtccgcgccgcaccactggatggcctgccagatcgacggcagcccgaacgcctcgccggcgtgaatggtgaagtggaagttctcccgctgcaggtactcgaaggcgtccaggtgccgggtgggcgggaatcccgcctccgccccggcgatgtcgaagcccaccacgccggcgtcgcggtgccgcaccgccagttcggcgatctcctgcgaccgggcggcgtgccgcatggcggtgagcagggtgccgacccggatcggatggccggcgtcggcggcgagcgccgcgccctcggcgaacccggcgacgaccgcctcgaccacctcgtccagggtcaggtcccgctccaggtgctgctcgggggcgaaccgcacctcggcgtagacgaccccgtcggcggccaggtccagcgcgcactcctgggccacccgccgcagtgcgggcgcggtctgcatgaccgccacggtgtgggcgaacgtctccaggtagcgctccagcgagccggagttcgccgccgcgacgaaccagcggccgagcgcttccgggtcggtggtgggcagctcgtggccgacctcggcggccagctcgacgatcgtcgccggccgcaggccgccgtcgaggtggtcgtgcagcagcgccttggggaccttgacgatgtcctcgtatgagattgcgaccatgcccagaccctagtagcgaccggccgggtcgccgacgcgaccggctgggaggatgtccaggtgatggacccccgcatcgtcgaccggctgcgttgcccggtctgcgcggaaccgctcaccgaggccgccgccgggaccacccgggcgctgcgctgcccgcgccggcacagcttcgacgtggcccgccaggggtacgtcgacctgctcgccggccgggccccgcacgtgggcgacaccgccgagatggtggccgcccgcgccgacttcctcgccgccgggcactacgacacgctctcggccgcgctcgccgccgccgcgctcgccgcgctgagccacccgccggaggcccccggagcggacgcgtcggccggcaaagacgggcaggatgcccaagccgggcgggatgcgtccgctggacatgacgcgtccgccggacagccggccgtcgggacgtacccgctggtggtggacgccggggcgggcacgggccggcacctcgccgcggtgctggcggcgctgcccgacgccgtgggcctggccctggacgtctccaagccggcgctgcgccgggcagcgcgggcccacccgcgcgcggcggcggcgctcgccgacacctggcggcggcttccgctggccgacgccagcgtcgccgtgctgctcgacgtcttcgccccgcgcaacggcgcggagttccgccgggtgctccacccggccggcgcgctgctcgtggtcacccccgccgaggaccacctcgccgaactggtcgactcgctcgacctgctgaaggtcgaccccgacaaggcggaccgggtcgccgggagcctggccggccacttcgagcagaccgccgagagcgtgctgcgggcccggctggaactcaccggccggcaggtggccaccctggtcgggatgggacccagcgcctggcacaccgacccggccaccctcgccgcccggatcgccgcgctacccgagccggtccgggtgaccctcgcggtacggctcggcgtgtaccgcccccgctgaccggggcgcggcccgccgctcaggtggaaaggtcgacctcttcccagcccggcggctcctcgtggtagggccctcgcaggaccaccgcccactccagcgcccaccggcgctgcccgatcgcgttggcgtcgaccaggccgggcggcgaccgcccgtcgcgctccagctccaggtacgcccagtcgaggcagtagtgcaggtcgagcagggccgccgcgtcggccgggtgctggggcgcggccaggatgcgggagcgccactgctggaagctctccccgcccgcgatgtgcggcagccgctccaccagccgctcgtcgaccggcagcgtcgggtcgagctgcttggccaggccgagcacccaggccagcgagaacagcgcgtcgtggtgcagcacgaacgaccggtggtcgccccggccgcccatcacgaactgccactccggcggggtgaccaggtcgaccaggtgggagttgagcagccagctcatcgccgcctgcgccggcatgccgaaacaccgggccaggatcacgtgcagcacggcgatgcgcgcctcgatctcgacggtcggccgcagctcgatctcgtcgcccggctcccacaccaggggaaactggctcggtggcagcggcagccccagccgggacagctcgtccaggctggcgtcacggacctctcgcgggtcgggagcggaaacgcgcacggctcagatccctgtcagtcgcatcggctcagtgccggtcgtcccccttggcctgggaggatagcggttcacgacgagcggcaccacggcgggcgggggcgggggcggttcagccgatccgctcgatgaccagcggctgcggggtcggggcggtcggcgagatccgtaccgcccggaccgcctcggccagcgccgccgggatcc

SEQ ID NO: 2 - DNA, 1248 bp, Micromonospora carbonacea
  CDS (1)..(1248): evdA
atgaccgattcagccgacggcacgccccggcgcggcacctgccgggcgtgtggcggcaccaccgcccagttcctcgacctgggtcggcagccgctctccgaccggttcctcaccgaggaccagctcgcggacgagttcttcttccacctggcggtgggggtctgcgcgggctgcacgatggtgcagctcatggaggaggtgccccgggaggagatgttccaccaggactacccgtaccactcgtcgggctcctccgtgatgcagaagcacttcgccgacaccgcgcggcacctgctggagcacgaggccaccggcccggacccgttcgtggtggagatcggctgcaacgacggggtgatgctgcgtaccgtccacgaggcgggagtgcggcacctgggcttcgagccgtcgggtggggtggccgatgtggcccgtgggcacggggtgcgggtggtcaccgagttcttcgaggagtccaccgcccgccgggtcagggagaccgacggccccgccgatgtgatcttcgcggccaacaccatctgccacatcccctacctcgactccatcctccggggcgttgacgcgctgctggcaccggacggggtcttcgtcttcgaggacccgtacctcggggacatcctggacaagacgtccttcgaccagatctacgacgagcatttcttcttcttctcggcgcggtcggtgcaggcgctggcggcccgcttcggcttcgcgctcgtcgacgtggaacgccttccggtgcacggtggggaggtccgctacaccatcgcccgtgccggcgcgcggcagccggccgagcgggtggccgcgctgatcggcgaggaggacgcccgaggggtcgccgaccgcagccggctcgacaggttcgccgccgacgtcgagggcatccgcaccgacctgctcgccctgctgaactcgctcaaggccgagggcaagcgggtggtggcgtacggcgcgacggcgaagagcgccaccgtgacgaacttctgcggcatcggtccggacctggtctcctgggtgtgcgacacgacgccggccaagcagggccggctcacccccggcacgcacatcccggtgcgcaccccggacgcgttcacgcccgacgcggtggactacgcgctgctcttcgcctggaaccacgccgacgagatcatggcgaaggagcaggagttccgccgggctggcggacagtggatcctgtacgtcccccgcgtacacgtgacgagc

SEQ ID NO: 3 - protein, 416 aa, Micromonospora carbonacea
  evdA
MTDSADGTPRRGTCRACGGTTAQFLDLGRQPLSDRFLTEDQLADEFFFHLAVGVCAGCTMVQLMEEVPREEMFHQDYPYHSSGSSVMQKHFADTARHLLEHEATGPDPFVVEIGCNDGVMLRTVHEAGVRHLGFEPSGGVADVARGHGVRVVTEFFEESTARRVRETDGPADVIFAANTICHIPYLDSILRGVDALLAPDGVFVFEDPYLGDILDKTSFDQIYDEHFFFFSARSVQALAARFGFALVDVERLPVHGGEVRYTIARAGARQPAERVAALIGEEDARGVADRSRLDRFAADVEGIRTDLLALLNSLKAEGKRVVAYGATAKSATVTNFCGIGPDLVSWVCDTTPAKQGRLTPGTHIPVRTPDAFTPDAVDYALLFAWNHADEIMAKEQEFRRAGGQWILYVPRVHVTS

SEQ ID NO: 4 - DNA, 1119 bp, Micromonospora carbonacea
  CDS (1)..(1119): evdB
atgaccatccgagtgtggggctacctgccggagtacgagaaggaacgggacgacctcctcgacgccgtgcagacggtcttcgagtccgggaacctcatcctcggcgcgagcgtgcgcggcttcgagcaggagttcgccgcctatcacgacatgccgcactgcgtcacggtggacaacggcaccaacgccatcaagctcgcactccaggcgctcgacgtcgggccgggcgacgaggtcatcaccgtctccaacacggccgcgccgacggtgctcgccatcgacgcggtcggcgcgacgccggtcttcgtggacgtccgcgccgacgactacctgatggacaccgagctgctggccgaggcggtcaccccccggacgaaggcgctgctgccggtgcacctctacggccagtgcgtcgacatggacccggtgctgcgggtggcccgggaacacggcctcaaggtcctggaggactgcgcgcagtcgcacggcgcgcgtcggggcggacggctggccggcacgatgggcgacgccgctgccttctcgttctatccgacgaaggtgctgggcgcgtacggcgacggcggcggcgtggtcaccgcggacgccgtgatcgacgagcggctgcggcggctgcgctactacggcatggaacaggtctactacgtcgtcgagacgccggggcacaactgccgcctcgacgaggtgcaggccgagatcctgcgccgcaagctgtgccggctcgacgactacatcgccgggcgccgcgccgtggcccggcgctacgaggagggcctggccgacatcgccgaccaggtcggcctgaccctgccggtgacggcgaccgacaacgaacacgtctggtacgtctacgtggtccgccaccccgcccgcgaccgcatcctcgaacagttggcggcgcgggacatcgcgctcaacatcagctacccctggccggtgcacaccatgaccggcttcgccaagctcggctaccagaccggctccctccccaccacggaacggttggccggcgagatcttctccctccccatgtatccctcgctgccgccggagacgcaggaccgggtgatcgacgcgctgcgcgacgtgctcgcggcgctc

SEQ ID NO: 5 - protein, 373 aa, Micromonospora carbonacea
  evdB
MTIRVWGYLPEYEKERDDLLDAVQTVFESGNLILGASVRGFEQEFAAYHDMPHCVTVDNGTNAIKLALQALDVGPGDEVITVSNTAAPTVLAIDAVGATPVFVDVRADDYLMDTELLAEAVTPRTKALLPVHLYGQCVDMDPVLRVAREHGLKVLEDCAQSHGARRGGRLAGTMGDAAAFSFYPTKVLGAYGDGGGVVTADAVIDERLRRLRYYGMEQVYYVVETPGHNCRLDEVQAEILRRKLCRLDDYIAGRRAVARRYEEGLADIADQVGLTLPVTATDNEHVWYVYVVRHPARDRILEQLAARDIALNISYPWPVHTMTGFAKLGYQTGSLPTTERLAGEIFSLPMYPSLPPETQDRVIDALRDVLAAL

SEQ ID NO: 6 - DNA, 1236 bp, Micromonospora carbonacea
  CDS (1)..(1236): evdC
gtggcggcggatcttcgcgcgccgctcacgccggcggggcgcacggtggtcgacctgcttgccggcgtgatcccgagaatcagtgcggaggccgccgaccgggaccgcaccggcaccttcccggtggaggcgttcgagcagttcgcgaagctcgggttgatgggcgccaccgttcccgccgagctgggcggcctggggttgacccggctgtacgacgtggcgaccgcgctgatgcggctggccgaggccgacgcgtccaccgcgctggcctggcacgtgcagctcagccggggcctcaccctcacctacgagtggcagcacggcacgccgccggtgcgcgcgatggcggagcggctgctgcgggcgatggcggagggcgaggccgccgtctgcggcgcgctcaaggacgcccccggcgtggtcaccgagctgcattccgacggcgccggcggctggctgctgtcgggccgcaaggtgctggtcagcatggcgcccatcgcgacccacttcttcgtgcacgcccagcggcgcgacgacgacggctcggtgttcctcgccgtgccggtcgtgcaccgcgacgcccccgggctcacggtgctggacaactgggacggcctgggaatgcgtgcctcggggacgctggaggtggtcttcgaccggtgcccggtccgggccgacgagctgctggagcgcggcccggtcggggcccggcgggacgccgtgctggccgggcagacggtcagctcgatcaccatgctcggcatctacgccggcatcgcccaggcggcccgggacatcgcggtcggtttctgcgcggggcgcggcggcgagccacgggccggtgcccgggcgctggtcgccgggctggacacccggctctacgcgctacgcaccacggtcggcgcggcgttgaccaacgccgacgcggcgtcggtcgacctgtccggcgacccggacgaacgcggccgacggatgatgaccccgttccagtacgcgaagatgaccgtcaacgagctggccccggcggtggtggacgactgcctcagcctggtcggcggcctcgcctacacggccgggcacccactctcccggctctatcgcgacgtgcgggccggcgggttcatgcagccctacagctacgtggacgccgtcgactacctgagcggtcaggcacttggactcgaccgggacaacgactacatgagcgtgcgcgcgctccgctcccggacctcggcg

SEQ ID NO: 7 - protein, 412 aa, Micromonospora carbonacea
  evdC
VAADLRAPLTPAGRTVVDLLAGVIPRISAEAADRDRTGTFPVEAFEQFAKLGLMGATVPAELGGLGLTRLYDVATALMRLAEADASTALAWHVQLSRGLTLTYEWQHGTPPVRAMAERLLRAMAEGEAAVCGALKDAPGVVTELHSDGAGGWLLSGRKVLVSMAPIATHFFVHAQRRDDDGSVFLAVPVVHRDAPGLTVLDNWDGLGMRASGTLEVVFDRCPVRADELLERGPVGARRDAVLAGQTVSSITMLGIYAGIAQAARDIAVGFCAGRGGEPRAGARALVAGLDTRLYALRTTVGAALTNADAASVDLSGDPDERGRRMMTPFQYAKMTVNELAPAVVDDCLSLVGGLAYTAGHPLSRLYRDVRAGGFMQPYSYVDAVDYLSGQALGLDRDNDYMSVRALRSRTSA

SEQ ID NO: 8 - DNA, 1167 bp, Micromonospora carbonacea
  CDS (1)..(1167): evdD
gtgaagatactgttcatcgcaggaccgacgaagtccagcctattcggcctggccccactggcaatcgccgcccggatgagcgggcacgaggtcgtgatggcttccacgcaggaggtcgtaccggcgacgatgtccgtcgggctgccggccttcccgctggcggcgctgaccctcgccgagctcatgaccaccgaccgggccggcgatccgctgcgcatcccggccgaggacgccgccttcgtccccttcgtcggccggatgttcggccggctggcggcgatcagcctggatccgctgcgcgacctggtcggcgggtggcggcccgacctgatcgtcggcggcccgcacgcctacgccgcgccgatcctggccaccgaacttggggtgccctgcgtgcggcacctgctcaccggcaacccggtggaccgcgagggcacccatccgggggtcgacgaggagctgcggccggagctggccgcgctcggcctggcccaggtgccgccgttccacctggccctggacatcttcccggccagcacccggatcgacgacgtcccgccggcgcagccggtgcgaccgctgcgctggattccgaccaaccagcagcagccggtggcgccgtggatgctctcgcgcgggccgcgtcgccgtgtcctggtcaccgccggcagtctggtcaccaccacccacaacttcgacttcctccacggactggccggcaccctggccgagcaggacgtcgaggtcgtggtcgcggcgccgccggaggtgggtcgggccctgcacgacgtgccgggtgtgcggcacgccggctggctcccgctggacgtggtgctgccccactgtgacctgatcgtgcaccactccggcacgatgaccgcgctgaccgccttgaacgcgggggtgccccagctgatcgtgccgcaggagagccggttcatcgagtgggcgcgcaacctgtcgaccctgggcgtggcgcagaccctcgcgccgggcgaggacacgccggaggccgtgggcaaggtcgcccgcctgctgctggaggatccggtccacgccaccagcgccgccgcgatcgcccgggagatcgccgagatgcccggccccacggaggtcgtgggccagctcaccgagttcgcgacccggggcctgacatgcgcgtcctcg

SEQ ID NO: 9 - protein, 389 aa, Micromonospora carbonacea
  evdD
VKILFIAGPTKSSLFGLAPLAIAARMSGHEVVMASTQEVVPATMSVGLPAFPLAALTLAELMTTDRAGDPLRIPAEDAAFVPFVGRMFGRLAAISLDPLRDLVGGWRPDLIVGGPHAYAAPILATELGVPCVRHLLTGNPVDREGTHPGVDEELRPELAALGLAQVPPFHLALDIFPASTRIDDVPPAQPVRPLRWIPTNQQQPVAPWMLSRGPRRRVLVTAGSLVTTTHNFDFLHGLAGTLAEQDVEVVVAAPPEVGRALHDVPGVRHAGWLPLDVVLPHCDLIVHHSGTMTALTALNAGVPQLIVPQESRFIEWARNLSTLGVAQTLAPGEDTPEAVGKVARLLLEDPVHATSAAAIAREIAEMPGPTEVVGQLTEFATRGLTCASS

SEQ ID NO: 10 - DNA, 924 bp, Micromonospora carbonacea
  CDS (1)..(924): evdE
gtgaccggcggagccgggttcatcggctcccacctcaccgacgcgctgctcgaacgcggcgacagcgtcaccgtgctcgacgacctgtccaccgggcggcccgagcggctgcccgccggggtgccgctgcaccacgggtcgatcaccgaccgggccgggttgacccggctggccgagcagtgtcgcccggaggtcatctgccacctggccgcccaggcggacgtgcgcaactcggtggccgacgccacctcggacaccggggtcaacgtggtcggcaccgtcaacgtcctggaggccgcccgggccatcgacgcccgggtggtcttcgcctccagcggcggcgccctctacggggaggtcgacgagctgccctcccccgaggacgtccggccggcgccgtgggcgccgtacggggccgccaagtactgcgcggagcagtacctggcgctctacaaccggctctacggctcgacccacgcggcgctgcggctcggcaacgtgtacgggccacgccaggacccgaccggcgaggccggggtcgtctcgatcttctgcggctgcctggtggccgggcgccggccgacggtgttcggcgacggcgagcagacccgggactacatctacgtggccgacgtggtggaggcgttcctgctcgcggtcgggcacggtggccccggcctgtggaacatcggcaccgggacctccaccagcatccgcaaactactggacctggtcggccgcaccgccgggcgcgtcccggacccccgcttcgagccaccccgcctgggcgagctgaagcactccgcgctggaggtgacccgcgcggcccgggagctgcgctgggcggcccgaacgaggctcgccgacggcatcgcgaaggtctacaagtgggtcgaggcggacgaaccggtccggggggagcga

SEQ ID NO: 11 - protein, 308 aa, Micromonospora carbonacea
  evdE
VTGGAGFIGSHLTDALLERGDSVTVLDDLSTGRPERLPAGVPLHHGSITDRAGLTRLAEQCRPEVICHLAAQADVRNSVADATSDTGVNVVGTVNVLEAARAIDARVVFASSGGALYGEVDELPSPEDVRPAPWAPYGAAKYCAEQYLALYNRLYGSTHAALRLGNVYGPRQDPTGEAGVVSIFCGCLVAGRRPTVFGDGEQTRDYIYVADVVEAFLLAVGHGGPGLWNIGTGTSTSIRKLLDLVGRTAGRVPDPRFEPPRLGELKHSALEVTRAARELRWAARTRLADGIAKVYKWVEADEPVRGER

SEQ ID NO: 12 - DNA, 1041 bp, Micromonospora carbonacea
  CDS (1)..(1041): evdF
atgacccgcgaggggtcaacgccgccggttagggtcgccaccatcacggtcggcaccaacgagatccgttggctggaccgcgcgctcggctcgctgctcgccagcgacacgaccggcttcgagctgacggtcttctacgtggacaacgcctcggccgacggcagcgtggcgcacgtcatgtcggcgtttcccggcgtccgggtcatccgaaacccccgcaatctcggcttcaccggcgcgaacaacgtcggcatgcgggcggccctggcggagggcttcgaccacatcttcctggtcaacccggacacctggacaccgccggggctggtccgcgggctggtcgagttcgcgcagcggtggccgcagtacggcgtcatcggcccgttgcagtaccgctacgacccggcgtcgaccgagttgaccgacttcaacgactggacgcaggtcgccctctacctgggcgagcagcacaccttcgccggcgacctgctggatcatccctcgcacgtcaccgcgacggtccgcgaccgcgcgccgcgcaccctggagcacgcgtacgtgcagggctcggcgctgttcgtccgggccgccgtgctacgcgaggtcggcctgctcgacgaggtgttccacacctactacgaggaggtcgacctgtgccggcgggcccggtgggcgggctggcgggtggcgctcctactcgacctcggcatccagcacaaaggcggcggtggcaccgccgcgagcgcgtacagccggatacacatgcgccgcaaccgctactactatctgctgaccgatgtggactggcccccggccaaggccgcccggctcgccgcccgctggctgttctccgacgtccgtgggcggggcgtgacgggtcggacgagcgcgggcgtcggggcgcgggagaccttcgtggcgctcgggtggctggcccgccaggccccggtgatccgggaacgtcgtcggcggcaccggctgctgcgggcacgagggacgggcgtggaccgcgcccgagagcggaaggaaaccgtgcgggga

SEQ ID NO: 13 - protein, 347 aa, Micromonospora carbonacea
  evdF
MTREGSTPPVRVATITVGTNEIRWLDRALGSLLASDTTGFELTVFYVDNASADGSVAHVMSAFPGVRVIRNPRNLGFTGANNVGMRAALAEGFDHIFLVNPDTWTPPGLVRGLVEFAQRWPQYGVIGPLQYRYDPASTELTDFNDWTQVALYLGEQHTFAGDLLDHPSHVTATVRDRAPRTLEHAYVQGSALFVRAAVLREVGLLDEVFHTYYEEVDLCRRARWAGWRVALLLDLGIQHKGGGGTAASAYSRIHMRRNRYYYLLTDVDWPPAKAARLAARWLFSDVRGRGVTGRTSAGVGARETFVALGWLARQAPVIRERRRRHRLLRARGTGVDRARERKETVRG

SEQ ID NO: 14 - DNA, 1053 bp, Micromonospora carbonacea
  CDS (1)..(1053): evdG
atgagcaggccacggattctcgtcgcgggcaacttccactggcaggccgggttcagccagaccgtcgccgcgtacgtgcgggcggcccgggaggccgactgcgaggtgcggctctgcggcccgctgtcccgggtcgacgccgagacggcccggcacctgccggtcgagccggacctccgctggggcacccacctggtgatcatgttcgaggccaagcagttcctcaccgaggcgcaactggacctcgtcgaggcgttcccccgacagcgccgggccatcgtcgacttcgacgggcactggggtgccgaggagggcggggacggcgacagcgcgtcgggccggtactccgcggagagttggcggcggttgtactcgaccctgagcgacctgatcctgcaaccccggctgggtccgctcccggccggcgcccggttcttcaagtgcttcggcctggcagcgccggtgcggcacccgctggaactgggcaccggcgcgcagtcgcgcccgtacgacctccagtacatcggcagcaactggtggcggtgggagccgatgaccgagatggtcgaggccgcggcggcggcccggccgccgctgcgccggctgcgggtgtgcggacgctggtgggacggcggcagttgcgcgggcttcgaggaggcgacgctcagcgagccgggctggctgcgggcgcgcggcgtcgaggtgcatccgcccgtgccgttcggccacgtggtcgagcagatgggccggtcgctgatctcaccggtcctggtgcggccgctggtcaccagcaccggcctgttgaccccccggatgttcgagacgctggcctcgggcagcctgcccgtgctcccggtcgccgcgaagttcctcgcgccggtctacggcgacgaggcggaacacctgatgctcggcgacgacccggccggaacgctgagccggctctcggccgagcacgaacggtacggacgactggtcggtgagattcaggaccggctccgcgtcgagtacggctaccctcgcgtcctgcgggacctgctcgatctgctggcc

SEQ ID NO: 15 - protein, 351 aa, Micromonospora carbonacea
  evdG
MSRPRILVAGNFHWQAGFSQTVAAYVRAAREADCEVRLCGPLSRVDAETARHLPVEPDLRWGTHLVIMFEAKQFLTEAQLDLVEAFPRQRRAIVDFDGHWGAEEGGDGDSASGRYSAESWRRLYSTLSDLILQPRLGPLPAGARFFKCFGLAAPVRHPLELGTGAQSRPYDLQYIGSNWWRWEPMTEMVEAAAAARPPLRRLRVCGRWWDGGSCAGFEEATLSEPGWLRARGVEVHPPVPFGHVVEQMGRSLISPVLVRPLVTSTGLLTPRMFETLASGSLPVLPVAAKFLAPVYGDEAEHLMLGDDPAGTLSRLSAEHERYGRLVGEIQDRLRVEYGYPRVLRDLLDLLA

SEQ ID NO: 16 - DNA, 1020 bp, Micromonospora carbonacea
  CDS (1)..(1020): evdH
atgacccccctgcggatcgcgatggtcaacataccgttccggttgccgagcgacgagcggcagtggatcacggtcccgccgcaggggtacggcgggatccagtggatcgtggccaacaagatcaagggcctgctcgaactcgggcacgaggtgttcctgctcggtgccccgggcagtccgcgtacgcatccacgcctgaccgtggtgccggcgggcgagcccgaggacatccgggcatggttgaagtccgctccggtggacgtcgtcaacgactacagctgcggcaaggtggatccgatcgagctgcccccgggggtcggcctggtggcctcgcaccacatgaccacccgcccgtcctatccggccggctgcgtgtacgcctcgaaggcgcagcgggagcagtgcggcggcggcgcggacgccccggtcatcccgatcggggtggatccgtcgctctaccgccccggcgaccgcaaggacgacttcctgctcttcatgggccggatctccccgttcaagggcgcgctggaggcggccgcgttcgcccgggccgccggccgccggctactgatggccggtccggcctgggagccggagtacctcgaccggatcatgggcgagtacggcgaccacgtcaccctcgtcggcgaggtggggggtcaggaacgtatggacctgctcgccacggcggctgccatcctggtgctctcccagccggtgcccggcccgtggggcggcacgtggtgcgagccgggtgcgaccgtggtgtccgaggcggcggccagcggcaccccggtggtcggcacgagcaacggctgcctggcggagatcgtgccggccgtcggcgaggtggtgggcttcggcaccggcttcgacgagcgggaggcccgagcggtgctgtcccgactgccgtcgcccgcccaggcgcggaaggccgcgatccggtgctgggggcacgtggagatcgcccggcgctacgaggcggtgtaccgcgacgtgctggccggcgcgcgctggtcc

SEQ ID NO: 17 - protein, 340 aa, Micromonospora carbonacea
  evdH
MTPLRIAMVNIPFRLPSDERQWITVPPQGYGGIQWIVANKIKGLLELGHEVFLLGAPGSPRTHPRLTVVPAGEPEDIRAWLKSAPVDVVNDYSCGKVDPIELPPGVGLVASHHMTTRPSYPAGCVYASKAQREQCGGGADAPVIPIGVDPSLYRPGDRKDDFLLFMGRISPFKGALEAAAFARAAGRRLLMAGPAWEPEYLDRIMGEYGDHVTLVGEVGGQERMDLLATAAAILVLSQPVPGPWGGTWCEPGATVVSEAAASGTPVVGTSNGCLAEIVPAVGEVVGFGTGFDEREARAVLSRLPSPAQARKAAIRCWGHVEIARRYEAVYRDVLAGARWS

SEQ ID NO: 18 - DNA, 759 bp, Micromonospora carbonacea
  CDS (1)..(759): evdI
atggccgtggggactgttggtgcggaggtcgtcgaccgtcggctggaggcttaccggcgcgatggcttcgtgactctcccgcagctcgccgacgacgccgaggtcgcctggctccgggccgcctacgaccggctcttcgccgatcacgcgtcgcccgacaccggcgactaccgggacatcgccggccgtggcgacgacgccgcgcctgcccgtctcccgcagatcgtccggccggagaaatacctgccggagttggtggagaccgcgcacttcgcgcgatgccgggccatcgcctccgctttcctcgacatccccgaggacgaactcgacttctacggccacgcgatcctcaagccgccgcgctacggcgcacccactccgtggcaccaggacgaggcgtacatggacccgcgctggtcccgtcgcggcctgagcatctggaccccgctcgacgaggcgacggtgtccagcggctgtctccagtacctgccgggcctgcaccggggcggggtgctcccgcaccatcacatcaaccacgacgaccgcatcgaaggtctgatgacggacgaggtcgacgacacggacagcgtcgcctgcccgctgcggccgggcgaggcggtcatgcacgacttccgtgcgccgcactacgccggcccgaacgagacggaccagccgcgccgcgcgtacgtcctggtgttcatgagccagccggtcgaggtgaccgaccccgagccgcgaccctggctgcacgaccggagc

SEQ ID NO: 19 - protein, 253 aa, Micromonospora carbonacea
  evdI
MAVGTVGAEVVDRRLEAYRRDGFVTLPQLADDAEVAWLRAAYDRLFADHASPDTGDYRDIAGRGDDAAPARLPQIVRPEKYLPELVETAHFARCRAIASAFLDIPEDELDFYGHAILKPPRYGAPTPWHQDEAYMDPRWSRRGLSIWTPLDEATVSSGCLQYLPGLHRGGVLPHHHINHDDRIEGLMTDEVDDTDSVACPLRPGEAVMHDFRAPHYAGPNETDQPRRAYVLVFMSQPVEVTDPEPRPWLHDRS

SEQ ID NO: 20 - DNA, 750 bp, Micromonospora carbonacea
  CDS (1)..(750): evdJ
atgaccgggcacagcgccgtcgcgctggacgtcggcggggtcgtctactacgacgagccgttcgagctggcctggctccaggacaccttcgaccgcctccaggccaccgacccgacgctcgacctgcgtgcgtttctggagcacgtcgagcggttctaccactacggcgagggcgacccaaccggccggacctggctccactcggaggccgccgcgctgagctggtcgcgggtccggcagtcctggggcgagctggcccaggagattcccggtgccgttcgcgcggtcaccaggctggccagggaactacccgtcgtgatcgtcgccaaccagccccccgagtgcgcggacgtactggcccggtggcaggtcagccaggtctgccgggaggtgctcctcgactccctcgtcggggtggccaagcccgacccggccctgctcgggctcgccctgcggcggctggcgatcccgcccgccgagttgctggtggtgggcaaccggacggatcacgacgtcctgcccgcgctcgggctcggttgcccggtggcgttcgtgctgcccgatccggcgtaccgccggccgccgggcgtccatccggacctggtccgggtctacacggagctgagggcgttccgcaccggctccccgcccgcggacgcccgggtcaccaccgtggcgtccctggcggccctggccgactctcccctgacgagtgccaccccgcgttcgaacgccggcaccggcggactt

SEQ ID NO: 21 - protein, 250 aa, Micromonospora carbonacea
  evdJ
MTGHSAVALDVGGVVYYDEPFELAWLQDTFDRLQATDPTLDLRAFLEHVERFYHYGEGDPTGRTWLHSEAAALSWSRVRQSWGELAQEIPGAVRAVTRLARELPVVIVANQPPECADVLARWQVSQVCREVLLDSLVGVAKPDPALLGLALRRLAIPPAELLVVGNRTDHDVLPALGLGCPVAFVLPDPAYRRPPGVHPDLVRVYTELRAFRTGSPPADARVTTVASLAALADSPLTSATPRSNAGTGGL

SEQ ID NO: 22 - DNA, 1245 bp, Micromonospora carbonacea
  CDS (1)..(1245): evdK
gtggtcggcgccaccggcttcatcggctcacgcctcgtctcccgcctggccgaggccgggcatccggtggcgcgcttcagccgtgccgccccacccgtcgtcgacggccggcccgcgccggggctccgcgaggcgcaggtcgtctacttcctcgccgcccggctgagcccggcgctggcggagcagcaaccggaacgggtcgtccgggaacgcgagttgttgctggacgtgctaagtgcgctggcgggggtggaccaccggccggtgttcgtcctggccagctcgggcggggcggtgtacacgccgacggtgtggccgccctaccacgagcggtcggccaccgggcccgcctcggcgtacggccgggcgaagctgcggctggaacaggagctgctgcgccacaccgaccgggtgcagccggtggtgacccggctgagcaacgtctacggtccggggcagcggccgacccccgggtacggtgtcctgtcacactggctggaggccaccgtgcgcggagagccgatccggctcttcggcgatccggccgtggtgcgggactacgtacacgtcgacgacgtcaccgcgatcatggaggtcatcgcgcagcgggccggtgacggcgaccgggaccggctgcccacggtcgtgaacgtcggctcgggcctgcccacctccctcgccgagttgctccagacgatgtccacggtggccggtcgtgagctggaggtcatccgggacgtccgccggcagttcgaccatcggggcaactggctcgacaccaccctcgcccgggagaccctgggctggcaggcgcggatcagcctccccgacggcgtccgccagtgctgggaggccgtcctcacccgggcgggcggcccggggggttccccggcccgaccgtcagcccggctcgggagagcgtctcgggggcgggaaccgccgcaaccgcgcccttcgcagcagttcgtggctcaacccggcggcggtcgccgcggtgtagccgagggccagtggcagggcgagccgggattccggggccgtacggtgccggtcccattccttgcgcaggccggcccgtgcctggttccgtccggcctcgcaccgcccctgccagtacgcccgccgcagcaggtaccggggggtcagccggcccgggtcgatgtcatgggtgaccgcgtggtccgggagcagttgctcgcgggcgccggcggccttcatggcgctgatgaaggaggtgtcctcccc

SEQ ID NO: 23 - protein, 415 aa, Micromonospora carbonacea
  evdK
VVGATGFIGSRLVSRLAEAGHPVARFSRAAPPVVDGRPAPGLREAQVVYFLAARLSPALAEQQPERVVRERELLLDVLSALAGVDHRPVFVLASSGGAVYTPTVWPPYHERSATGPASAYGRAKLRLEQELLRHTDRVQPVVTRLSNVYGPGQRPTPGYGVLSHWLEATVRGEPIRLFGDPAVVRDYVHVDDVTAIMEVIAQRAGDGDRDRLPTVVNVGSGLPTSLAELLQTMSTVAGRELEVIRDVRRQFDHRGNWLDTTLARETLGWQARISLPDGVRQCWEAVLTRAGGPGGSPARPSARLGRASRGREPPQPRPSQQFVAQPGGGRRGVAEGQWQGEPGFRGRTVPVPFLAQAGPCLVPSGLAPPLPVRPPQQVPGGQPARVDVMGDRVVREQLLAGAGGLHGADEGGVLP

SEQ ID NO: 24 - DNA, 912 bp, Micromonospora carbonacea
  CDS (1)..(912): evdL
atgccgaacaacgcctctgtggtcagccgcgatccgtccgaccacccgatggtggtggcgatctgcgcgttccgggtggagaacgtcaggaaacacctcgcgcacaacatggcccagctctccggcgacgagtactacgtcctgctggaccggcccgtcacggccgaggcggaggaggtcgccgaggaggtccgggccgccggcggcaccatgcgcatcctcggtgccaccaatggcctgtcggcctcccgcaacgcgatgctcgcccgctggccgcaccaccatctgatgttcgtcgacgacgacgtgcggctcgacgccgctgccgtcgacgccgtccgcaagagcctgcgcgacggcgcgcacgtggtcggcacccggctggcccgccccgcgctgcgtctgccgtggtacgtcacctccggccagttccacctggtcggctggcaccgtgaccagggaaacatcaagatctggggcgcgtgcatgggggtggactccgcgttcgcgcacgcccacgggttggatttcgacctggccctcagccgtaccgggggcaacctccagtcaggggaggacacctccttcatcagcgccatgaaggccgccggcgcccgcgagcaactgctcccggaccacgcggtcacccatgacatcgacccgggccggctgaccccccggtacctgctgcggcgggcgtactggcaggggcggtgcgaggccggacggaaccaggcacgggccggcctgcgcaaggaatgggaccggcaccgtacggccccggaatcccggctcgccctgccactggccctcggctacaccgcggcgaccgccgccgggttgagccacgaactgctgcgaagggcgcggttgcggcggttcccgcccccgagacgctctcccgagccgggc

SEQ ID NO: 25 - protein, 304 aa, Micromonospora carbonacea
  evdL
MPNNASVVSRDPSDHPMVVAICAFRVENVRKHLAHNMAQLSGDEYYVLLDRPVTAEAEEVAEEVRAAGGTMRILGATNGLSASRNAMLARWPHHHLMFVDDDVRLDAAAVDAVRKSLRDGAHVVGTRLARPALRLPWYVTSGQFHLVGWHRDQGNIKIWGACMGVDSAFAHAHGLDFDLALSRTGGNLQSGEDTSFISAMKAAGAREQLLPDHAVTHDIDPGRLTPRYLLRRAYWQGRCEAGRNQARAGLRKEWDRHRTAPESRLALPLALGYTAATAAGLSHELLRRARLRRFPPPRRSPEPG

SEQ ID NO: 26 - DNA, 951 bp, Micromonospora carbonacea
  CDS (1)..(951): evrA
atgggcgcgcggcgtgtcgtggtcgtcggtggtacgggcttcgtcgggcgtcacgtgagcgccgcgcttgccgcccggggcgacgacgtcctcgtgttggcccgccgcgtcccgtcggcggggctgccgtaccgggcccgggcgctggacgtcgccaccctggagcccgccgcgctggccgccgtgttcgacgccgagcagcccgacgcggtggtcaacgccaccggcggcaagtggaacctgacggacgccgagctgccgtcgagctgcacgatcccgacgtggagtgtcaccgcggcgctggagcgcacccgttgccggcccaggctggtgcacctcggctcggtcctggaacgcgtccaggagccacccggggctcccgccggtgccacggtgcccacccagccggagagcatgtacggcagggcgaagctggccgccacccaggccgtgctcgcggcgacgcgggccggctcggtggacgcgacggtgctgcggctcgcgaacgtggtgggtccgggcgtgccacccgacagcctgttggggcgggtcgtcgttcgcctggtcgacgcggcgggccgcgaccggtcggccagggtggagttgtctccgttgcgcgcccaccgggactacgtcgacgtgcgggacgtcgccgaggcggtggtgtcggccacgcgggagtccgtcaccgggcgggtgatcggcgtggggcggggggaggccgttccggtccgctccctcgtggagatgttgatcgaggtgagcggggtgccgaccgaggtggtggagttgccggatcggcccggctcggtggaggtcgtcgactgggcccgcgtcgacccggggcccgcgcgtgacctgctcgggtggcggccccgacgatcgctgcgggatgcggtgggcgggctctgggacgaggccgcgagtcggcttcccgatcggtcccggcgc

SEQ ID NO: 27 - protein, 317 aa, Micromonospora carbonacea
  evrA
MGARRVVVVGGTGFVGRHVSAALAARGDDVLVLARRVPSAGLPYRARALDVATLEPAALAAVFDAEQPDAVVNATGGKWNLTDAELPSSCTIPTWSVTAALERTRCRPRLVHLGSVLERVQEPPGAPAGATVPTQPESMYGRAKLAATQAVLAATRAGSVDATVLRLANVVGPGVPPDSLLGRVVVRLVDAAGRDRSARVELSPLRAHRDYVDVRDVAEAVVSATRESVTGRVIGVGRGEAVPVRSLVEMLIEVSGVPTEVVELPDRPGSVEVVDWARVDPGPARDLLGWRPRRSLRDAVGGLWDEAASRLPDRSRR

SEQ ID NO: 28 - DNA, 1032 bp, Micromonospora carbonacea
  CDS (1)..(1032): evrB
atggcggagatgacggtccgcatcggggttctcggctgcgccgacatcgcgcgccgccgtgccctgccggcgatcaggcgggtcccggaggcggagctcgtggtggtcgcggcgcgggaactggccaaggcgcgcgccttcgccgcggagttcgggtgcgccgccgccgagggctaccagtccgttctcgaccgcccggacatcgatgccgtctacattccgctgccgaccgggctgcaccacacctggatcgaacgcgccctggccgcgggcaaacacgtgctggtggagaagccgctgaccacccggctggtcgacaccgcggcggtgctgacccaggcccggtcgcgtgggctcgtgttgatggacaacctcaccttcctccgacatggggtgcaccacttcgtgcgccggatggtcgcggccggcgagatcggcgagctgcggatggtctccggcgtcttcgggtttccgccgctgcctgcgggcgacatccgttaccgacccgagctgggtggcggagcgctgctggatctgggcgtctacccgttgggcgcggcccggttcttcctgccggaggagccggaggtggtggcggccaccctccgggaggaccccgatcgcggcgtggacgtttcgggtgccgcgctgttgtgtacgccggacgggcggaccgcacagatcgccttcggtttcgagcactcctaccggtgcgagtaccagctctggggaagcgccggccggatcgtcgtcgaccgggcgtacaccccaccgccggcctggcacccggtggtgcgggtggagcggcaggacgagacgcgggagctgaccttcccggccgaggaccagttcgtcaacacgatgcgagagttcgtccgcgccgtcaccgccggtcagccggcggaggaggtgacggcgatccgcgcccgggcccggctgctggacgaggttcgcgaccgggccagggtgttgcgcgcccccgtgacctgtcaggggccgggcggtcgcctggacgccgccggcgcacgagac

SEQ ID NO: 29 - protein, 344 aa, Micromonospora carbonacea
  evrB
MAEMTVRIGVLGCADIARRRALPAIRRVPEAELVVVAARELAKARAFAAEFGCAAAEGYQSVLDRPDIDAVYIPLPTGLHHTWIERALAAGKHVLVEKPLTTRLVDTAAVLTQARSRGLVLMDNLTFLRHGVHHFVRRMVAAGEIGELRMVSGVFGFPPLPAGDIRYRPELGGGALLDLGVYPLGAARFFLPEEPEVVAATLREDPDRGVDVSGAALLCTPDGRTAQIAFGFEHSYRCEYQLWGSAGRIVVDRAYTPPPAWHPVVRVERQDETRELTFPAEDQFVNTMREFVRAVTAGQPAEEVTAIRARARLLDEVRDRARVLRAPVTCQGPGGRLDAAGARD

SEQ ID NO: 30 - DNA, 1452 bp, Micromonospora carbonacea
  CDS (1)..(1452): evrC
gtgagcgattcgtcgcccgacccgaaggtccgcgccgacgggccgttgctgacccgggacgcgggcccgcaccggcccggcccggtcgacggcggctcgtggtcggcgttgcacgccgagggggtccggccggacttcctctcctggttcgccgagcggacccggtcgacctactgccgggtggaccgcgtgccgctggaccggctgcccgggtgggcgttcgacccggtgaccggcaacctcgggcacgagagcggccggttcttcgtgatcgaggggctgcacgtccagaccacctacggcgcggtgcgcgaatggcaccagccgatcatcaaccagccggagatcggcatcctcggcatgctcgtcaaggtcgtcgacgggacaccgtactgcctgctccaggccaaggtggagcccggcaacatcaacgtcatgcagctctcgccgacggtgcaggccacccggagcaactacacccgggtgcaccgtggcggcggcacgaagtacctcgactacttcacccgcccgggggccggtcgggtgctggttgacgtcctgcagtcggagcagggctcctggttcctgcgcaagcgcaaccggaacatggtggtccaggtcgacgaggacgtgccggccggcgactaccaccggtggctcccgctgcgcgaactgctcgcgctgctgcgggtggacggcctggtcaacatggacacgcgtacggtgctgtcatgtctgccctcggccttctacgccgcggcccaggagaccgaggcgccgtcgtcgccggcggtggcggcgatcgtgcgctcggcggcgggcgcccccggccgccacgacctggtgtcggtgttgagctggttcaccggggccaagggccggcacgagatgaccgtgcggcgggtgccgctacgagggctgccggactggcggcacaccgcggacgggatcgcgcgggacgacggccggcacttctccgtggtcggcgtcacggtgcgcatcgacaaccgcgaggtgaccgggtggagtcagccgctgttgtatccgcggcaccggggcgtggtcgccttcctggtcaaggaaatcgacggagtggcgcacctgctggtgcacgcgcgctaccaggcggggctgctcgacgcgatggagatgggcccaacggtgcagtgcatcccggacaaccagcccggcccccgaccactgttcctggccgaggtgctggaagccgcccccgagcgtgtcctctacgacaccgtgctcaccgaggagggcgggcgattctaccggtcggagaaccgttacctcctggtcgacgccggcgacgacttcccgaccgaggtgccggacgagttctgctgggtgacggtgcgccagctggaggccctgctccggcacggctactacctcaacatcgaggcccgcagcttgctggcctgcctgcgcagcctgtgg

SEQ ID NO: 31 - protein, 484 aa, Micromonospora carbonacea
  evrC
VSDSSPDPKVRADGPLLTRDAGPHRPGPVDGGSWSALHAEGVRPDFLSWFAERTRSTYCRVDRVPLDRLPGWAFDPVTGNLGHESGRFFVIEGLHVQTTYGAVREWHQPIINQPEIGILGMLVKVVDGTPYCLLQAKVEPGNINVMQLSPTVQATRSNYTRVHRGGGTKYLDYFTRPGAGRVLVDVLQSEQGSWFLRKRNRNMVVQVDEDVPAGDYHRWLPLRELLALLRVDGLVNMDTRTVLSCLPSAFYAAAQETEAPSSPAVAAIVRSAAGAPGRHDLVSVLSWFTGAKGRHEMTVRRVPLRGLPDWRHTADGIARDDGRHFSVVGVTVRIDNREVTGWSQPLLYPRHRGVVAFLVKEIDGVAHLLVHARYQAGLLDAMEMGPTVQCIPDNQPGPRPLFLAEVLEAAPERVLYDTVLTEEGGRFYRSENRYLLVDAGDDFPTEVPDEFCWVTVRQLEALLRHGYYLNIEARSLLACLRSLW

SEQ ID NO: 32 - DNA, 1062 bp, Micromonospora carbonacea
  CDS (1)..(1062): evrD
gtggcttcacggctggagactaccctgacacggcgggcgctgatcactggaattaccggccaggacggcacgtatctcgcggagcacctgcttcagtccggatacgaggtatttggattggtgcgcgggcagaccgcgccctcggtccgcagccttcggcaacctgatccagcggtcaagctgatcagcggcgaccttctggatcagacgagcctggtggcggcgatcgaacgcgcggcgccggacgaggtctacaacctcggcgcgctgtcgtacgtgccggtgtcgtggcggcagtccaccacgacggcggaggtcaccggcatgggtgtgctccgcatgctcgaagccttgcggatcgtggggggcctgtcggattcccgcagtcccgcagccggtcagccgcgcttttatcaggcgtcttcgtcggagatgttcggcaaggtgcgggagcccgtccagaatgagctgaccccgttccatccgcgtagcccgtacggcgcggccaaggcgttcgggcattacatggtgcagaactaccgtgagtcgtacggcatgtatgccgtctccggcattctgttcaaccacgaatcaccggtgcgtggtcccgagttcgtcacccgcaaggtgtcgctgggcgtggcggcggtgaagctgggcattcgcagctcgcttcgcctgggcaacctctcggccgagcgggactggggcttcgcgggcgactacgtgcggggcatggtcctgatgctggcccaggacgagccggaggactacgtcctcggcacgggggtcacgcacagcgtccgcgagctggtcgaggcggccttcgcccacgtgggcctcaactggcgggaccacgtggtggtggacgagtcgctcatccggcccgccgaggtcgagctgctctgcgcggatccgacgaaggcccgccagcggctcggctggaaaccctccgtctccttcgaggagatggtcgccatgatggtcgacagcgatctgcgcctgttggcggacacggacgggtcttcccacgccttttccgccgaactggccgagctgtgg

SEQ ID NO: 33 - protein, 354 aa, Micromonospora carbonacea
  evrD
VASRLETTLTRRALITGITGQDGTYLAEHLLQSGYEVFGLVRGQTAPSVRSLRQPDPAVKLISGDLLDQTSLVAAIERAAPDEVYNLGALSYVPVSWRQSTTTAEVTGMGVLRMLEALRIVGGLSDSRSPAAGQPRFYQASSSEMFGKVREPVQNELTPFHPRSPYGAAKAFGHYMVQNYRESYGMYAVSGILFNHESPVRGPEFVTRKVSLGVAAVKLGIRSSLRLGNLSAERDWGFAGDYVRGMVLMLAQDEPEDYVLGTGVTHSVRELVEAAFAHVGLNWRDHVVVDESLIRPAEVELLCADPTKARQRLGWKPSVSFEEMVAMMVDSDLRLLADTDGSSHAFSAELAELW

SEQ ID NO: 34 - DNA, 1530 bp, Micromonospora carbonacea
  CDS (1)..(1530): evrE
atggtcgcgttggtcgcggtgatgatcccgatggtgctggccaccctcgacaacaccatcatcggcaccgcactgcccaccgtggtcggcgagttgggcggcctcagcacgctctcctgggtgatcacctcgtacacgctggccacggccgcctccacgccggtctggggcaagctcgccgacatgtacggcggcaaggtggtcttcgtggccacgctggtcgtgttcctggccgggtcgctgctgtccggcatggcgcagagcatcacccagctgaccgtcttccgggccgtgcacgggctcggcgcgggcggcctgatggtctgcgcgttcgccatcatggtggaggttctcgccggccctgacctgcccaagtaccagggcatcatgtcggcgaccatgggcctgaccatggtggcgggcccgctcgtcggcggcctgatcaccgatgagctcggctggcgctggtgcttctacatcaacctgccgatcggggcggtcgcgctgctcatcgtggtgctgatgatgcacctgccgcgccgacacaccaaggcccggatcgattacgcgggtgctgccctgctcaccgtggtcagttcgtgcgtcgtgctggtgaccacctggggcggcatcacctacccctgggcgtctccgatgatcctggggctggtcgcgctcggggtgctgacctgcgcgctcttcgtggtggtcgagcgacgggtggccgagccgttggtgcccctggccatgttccgcagcctgaacttcaccctgagcaccctcatcgccttcctggtcggcttcgccctcatcgcggggctgaccttcctggccctgttccagcaggcggtgcagggtgcctccgcgtccgactccggcctgttgctgctgcccctgctgctgtccatggcggcggtcaacgtggtcgggggtcgcctgatgagcggcgggcgttcctaccggctgctgatgctcgccggtgcggcgctgatgaccctgagcctgctgctcttcgccctgatggacgtgggcaccagccggacggtcaccgcgatccccatggtcggcttcggcgcagggctggggctgctcatgcagaccagcctgatggtggcgctgagcagcgtggagatgaggaacctcggggtggccgcctccacgtccacgctcttccgcaccatcggtggggcggtgggggcgtcggcgacggtctcgctgttctccgtgcgggtgcagtcggcgctggccgatcggggggtcgccgacgtggctgacctcctcggccactccgcgcggctggacgccgccgggctggcccaactcccccgggccgtccgtgtccacttcatgcacgcggtggcctccggcacccggtgggccttcctgatgaccgtgctggcggggctgatctgcgtcgcggcggcgtggttcctgcgccgggtcaccccgttgacgtcggcaccggtggcacccgaaccggcgcgcgacgtcgccgcgcccgccgccagcagcgggcgcgcgccgaactac

SEQ ID NO: 35 - protein, 510 aa, Micromonospora carbonacea
  evrE
MVALVAVMIPMVLATLDNTIIGTALPTVVGELGGLSTLSWVITSYTLATAASTPVWGKLADMYGGKVVFVATLVVFLAGSLLSGMAQSITQLTVFRAVHGLGAGGLMVCAFAIMVEVLAGPDLPKYQGIMSATMGLTMVAGPLVGGLITDELGWRWCFYINLPIGAVALLIVVLMMHLPRRHTKARIDYAGAALLTVVSSCVVLVTTWGGITYPWASPMILGLVALGVLTCALFVVVERRVAEPLVPLAMFRSLNFTLSTLIAFLVGFALIAGLTFLALFQQAVQGASASDSGLLLLPLLLSMAAVNVVGGRLMSGGRSYRLLMLAGAALMTLSLLLFALMDVGTSRTVTAIPMVGFGAGLGLLMQTSLMVALSSVEMRNLGVAASTSTLFRTIGGAVGASATVSLFSVRVQSALADRGVADVADLLGHSARLDAAGLAQLPRAVRVHFMHAVASGTRWAFLMTVLAGLICVAAAWFLRRVTPLTSAPVAPEPARDVAAPAASSGRAPNY

SEQ ID NO: 36 - DNA, 1476 bp, Micromonospora carbonacea
  CDS (1)..(1476): evrF
atgtccagcaagatcctagtcatcggtggaggtccggccggatccacggccgccgcgctgctcgcccgatcggggctgtcggtgacgctcctggaaaaggagacgttcccgcgataccacatcggcgagtcgatcgcgtcctcgtgccgcaccatcgtcgatttcgtgggcgctctcgacgaggtcgactcgcggggctacccgcagaagaacggggtcctgctgcgctggggcaacgaggactgggccatcgactgggccaagatcttcggtccgggcgtgcggtcctggcaggtcgaccgggacgacttcgaccacgtcctgctcaacaacgccggcaagcagggcgccaagatcatccagggcgcggctgtcaagcgggtgttgttcgacggtgagcgggccaccgccgccgagtggttcgaccccgagtcgggtgaggtccgcaccatcgatttcgactacgtggtcgacgcgtccggccgggccgggctgatcccgtcccagcacttcaagcaccggcgccccaccgagacgttcaagaacgtggccatctggggctactggcagggtggctcgctgctgccgaactctccctccggcgggatcaacgtcatctccgcgcccgacggctggtactgggtcattccgctgcgcggcgaccggtacagcatcggcttcgtctgccaccagagccgcttcctggagcggcgcaaggagcacgcctcgctggaggacatgctcgccgcactggtacaggagtccccgaccgtgcgcggcctgacggcgaacgggacgtaccagccgggcgtgcgggtggagcaggacttctcgtacatctccgacagcttctgcgggcccggctacttcgcggccggcgactccgcctgcttcctggacccactgctgtccaccggcgtgcacctcgccctctacagcggcatgctcgcctcggcgtccatcctggccaccatccacggtgacgtcaccgaggaggaggcgcgggcgttctacgagtccctctaccgcaacgcctaccagcgcctgttcaccctcgtcgccggcgtctaccagcagcaggccggcaagagggcatacttcggcctggccgacgcgctggtgcacgacagcggcgaacccgagtacgagaaggtagacggggcccgcgccttcgcccagctcgtcgccggcctcgccgacctggacgacgcggcggagggacggcacgacagcaccgcggcggcggcaccggcggagcaggacaactccgtccggcagctcttcctggccgccgaggaggcccgccggatggccgacgcgcgcacgccgagcgccccggtcagcgaggcgccgggcaagctcgacagccacgacctcttcgactcggcaaccggcctctacctggtcaccaccccgcgactggggatccgccgggccaagccggccgacacgcaggcggcggcagagcagtctgcc

SEQ ID NO: 37 - protein, 492 aa, Micromonospora carbonacea
  evrF
MSSKILVIGGGPAGSTAAALLARSGLSVTLLEKETFPRYHIGESIASSCRTIVDFVGALDEVDSRGYPQKNGVLLRWGNEDWAIDWAKIFGPGVRSWQVDRDDFDHVLLNNAGKQGAKIIQGAAVKRVLFDGERATAAEWFDPESGEVRTIDFDYVVDASGRAGLIPSQHFKHRRPTETFKNVAIWGYWQGGSLLPNSPSGGINVISAPDGWYWVIPLRGDRYSIGFVCHQSRFLERRKEHASLEDMLAALVQESPTVRGLTANGTYQPGVRVEQDFSYISDSFCGPGYFAAGDSACFLDPLLSTGVHLALYSGMLASASILATIHGDVTEEEARAFYESLYRNAYQRLFTLVAGVYQQQAGKRAYFGLADALVHDSGEPEYEKVDGARAFAQLVAGLADLDDAAEGRHDSTAAAAPAEQDNSVRQLFLAAEEARRMADARTPSAPVSEAPGKLDSHDLFDSATGLYLVTTPRLGIRRAKPADTQAAAEQSA

SEQ ID NO: 38 - DNA, 1422 bp, Micromonospora carbonacea
  CDS (1)..(1422): evrG
atgtcacgctccctcagacgggacgcgcaggccgcccaggcggcaccggcgtcgcccgccaacccgcacgccgggcacgccgccccggtgcccagccgggtcagcacgaccacggtcgcggtcaccccgttcaccgagccgatgcccgtcccgccgcggctgaccccggtctcccgccgcgacggcatcgacgtctacgagatccccatccggccggcgcaggtgcagatcctgcccggcctgctcacgcccgcctacacctacgccggttccttcgtcggccccaccatccgggcccgcacgggccggcccgtgcggatcacctacaccaacgggctcgacacccacgccaacgtgcacctgcacggcgggcacgtgccggccaccagcgacggtcacccgatggacctgatcccgccgggcggctcgaaggtctacgactacccgaaccttcagcgcggcgcgacgctctggtaccacgaccacacccacgcctacgaggccgaccacgtctaccgcggactgcacggcttctatctgatcgacgacccggccgagcatcacctgcgcctgcccgccggcaagtacgacgtgccgatcatgctgcgcaacgcccagttcgacgactccggcgccctcgtcttcggccacccggacgaccgggtcaccatcctggcgaacggcaaggcccagccctacttcgaggtggccccgcgcaggtaccggttccgcctgctcaacgcggcgctgaagcacgtcttccggctcaacctgggcggcgaaccgctcacccgcatcgccacggacggcgggctgctgcccgcccccaccagtcacaccgagctggcgctctcctccggggagcgggtcgagattgtgatcgacttcgccgagcacgcaggcggcgggccggtctacctctacgacggggacaacccgatcctgcgcttcgacgtgtcgtcccgggcggtcaccgaccccagccgggtgccggtcaccctgcgcgcactgcccccgatgggcacgccgaccgtggagcgcaccgtgtcgatgagcttcgacatgtcggcccggcccccgatcgcgctcatggacggcaaaccgttcgaccctctccgggtggacgtacaggtcaagcggggcagcaccgagatctggaacgtggtcaacgcggataccgatccgttccccttcgaccatccgttccacctgcacctggtgacgttccgggtgctcggccgcgacggcgggccgcccgcgccggaggacgccgggctcaaggacaccgtctacgtctcgcccaaggggtctgtcaagatccaggtcaccttcgccacgccgtacctcgggcagtacgtctaccactgccactacctggagcactcgtcgctggggatgatggcccagctggaggttgtgccc

SEQ ID NO: 39 - protein, 474 aa, Micromonospora carbonacea
  evrG
MSRSLRRDAQAAQAAPASPANPHAGHAAPVPSRVSTTTVAVTPFTEPMPVPPRLTPVSRRDGIDVYEIPIRPAQVQILPGLLTPAYTYAGSFVGPTIRARTGRPVRITYTNGLDTHANVHLHGGHVPATSDGHPMDLIPPGGSKVYDYPNLQRGATLWYHDHTHAYEADHVYRGLHGFYLIDDPAEHHLRLPAGKYDVPIMLRNAQFDDSGALVFGHPDDRVTILANGKAQPYFEVAPRRYRFRLLNAALKHVFRLNLGGEPLTRIATDGGLLPAPTSHTELALSSGERVEIVIDFAEHAGGGPVYLYDGDNPILRFDVSSRAVTDPSRVPVTLRALPPMGTPTVERTVSMSFDMSARPPIALMDGKPFDPLRVDVQVKRGSTEIWNVVNADTDPFPFDHPFHLHLVTFRVLGRDGGPPAPEDAGLKDTVYVSPKGSVKIQVTFATPYLGQYVYHCHYLEHSSLGMMAQLEVVP

SEQ ID NO: 40 - DNA, 1044 bp, Micromonospora carbonacea
  CDS (1)..(1044): evrH
atggcacggaccctgcgagggctggaggaggtggccgcccaggagatcgaggagcggggcctcggccgggtcgagcaccgccggcaccgcgaggtgtggttctccgccgccagcgcggagccgcgcctgctggatctgcgtaccgtcgacgacctgttcctgctcgtcgccgtcgccgacggcgtcggccacaccaaggcggacctggcggccttcacccggctggcccgggcggcggcgctgccggcggtgctgccggcccgcgccgcctgcggcgtgcccgggcggccggcgaccgtggacgtcgccgcctccttcctcggccgccgcaactacaaccggtacgacatcgaggacgccgtggggcggcacgcggtggccgcgctcgggttgcgctaccactcccgccgcggcggcgaggccccgccggagggcgggctgtcgctgcgggtcaccgtcgagggcacccaggcgacgctggcggtacgggtggccgaccggccgctgcaccggcgggcctacaagcggtcgtccacgccggggaccctgcatccgccgctcgccgcggcgctggcctggctggccggcatccgccccgggatgctggtggccgatccgtgctgcggcaccggcacgatccccgtggaggcagccgggctggcaccgggggcggtgctgttcggctcggaccacgacccggagacggtcggcgcggccgtcgccaactcggcggcgtcgggggcccgcgtcacctgggcggtcgccgacgccggacgattgccgctgcggaccggtcgggtggaccgggtggtcagcaatccgccctgggaccggcaggtgcaggcgcggggcgtgctcgccggtgattccggccgcctcttcgcggagctgcgccgggtgacggtcgacggcgggcgggcggtactgctgctgcacgagttcgccgaccaggccgacctggcccgcgccgccgggttcggggtgggcgacgtgcggccggtcagcctgttcggcgcccacccctcgatcgtcgacctgcacggc

SEQ ID NO: 41 - protein, 348 aa, Micromonospora carbonacea
  evrH
MARTLRGLEEVAAQEIEERGLGRVEHRRHREVWFSAASAEPRLLDLRTVDDLFLLVAVADGVGHTKADLAAFTRLARAAALPAVLPARAACGVPGRPATVDVAASFLGRRNYNRYDIEDAVGRHAVAALGLRYHSRRGGEAPPEGGLSLRVTVEGTQATLAVRVADRPLHRRAYKRSSTPGTLHPPLAAALAWLAGIRPGMLVADPCCGTGTIPVEAAGLAPGAVLFGSDHDPETVGAAVANSAASGARVTWAVADAGRLPLRTGRVDRVVSNPPWDRQVQARGVLAGDSGRLFAELRRVTVDGGRAVLLLHEFADQADLARAAGFGVGDVRPVSLFGAHPSIVDLHG

SEQ ID NO: 42 - DNA, 1074 bp, Micromonospora carbonacea
  CDS (1)..(1074): evrI
atgccgcacgggcccgtgcgccgaaatcgtggagattgcgcagtgcgtacaccggatctgttcatcggcgccgtcggcgccttcgtcccgccgacggtgagcgtcgagtgggcgatcgaccgcggtctttactcccgcgagcaggtggagctgcacgagctggcgggcacggccatcgccggcgacctgcccgcgccggagatggcgctgcgcgccgcccaacaggcggtcaagcgctggggcggctcgccgacggagttcgacctgctgctctacgccagcacctggcaccaggggcccgacggctggccgccgcactcctatctccagcggcacctggtcggcggcgacctgctggcgttggagatccggcagggctgcaacgggatgttcagcgcgttcgagctggccgccagccacctccaggcggtacccgagcgcaccagcgccctgctggtcgccgccgacaactacggcaccccgatggtcgaccgctggcggatgggccccggcttcatcggtggcgatgccggcagcgccctcatcctcaccaagcgacccggcttcgcgcggctccgctcggtctgcaccaagtcggtcccggaggccgagcggctgcaccggggcgacgagccgctgttccccccgagcgtcctgaccggccgggagctgaacttcaccgcccggatcgaccaacagttcgccgcccgcagccccgcctcgatcgccatggcggacgtcggcgaccacatcgaggaggtcgtggggcgcgccctcgccgaggcggagatcgaggtcggcgacctcgccagggtcgccttcatgaacttttcccgggagatcatggagcagcgctgcctggccaactggggcctgcccatgagccggtccaccttcgacttcggtcgccggatcgggcactgcggggcgagcgaccccttgctggccctggaacacctggccaggacggggggcctcggccccggcgatcacctgctgaccctcggcaccgcgccgggcgtggtggtgtcgtgcgcgatcgtccaggtgatcgagtcgccgacgtggcgggag

SEQ ID NO: 43 - protein, 358 aa, Micromonospora carbonacea
  evrI
MPHGPVRRNRGDCAVRTPDLFIGAVGAFVPPTVSVEWAIDRGLYSREQVELHELAGTAIAGDLPAPEMALRAAQQAVKRWGGSPTEFDLLLYASTWHQGPDGWPPHSYLQRHLVGGDLLALEIRQGCNGMFSAFELAASHLQAVPERTSALLVAADNYGTPMVDRWRMGPGFIGGDAGSALILTKRPGFARLRSVCTKSVPEAERLHRGDEPLFPPSVLTGRELNFTARIDQQFAARSPASIAMADVGDHIEEVVGRALAEAEIEVGDLARVAFMNFSREIMEQRCLANWGLPMSRSTFDFGRRIGHCGASDPLLALEHLARTGGLGPGDHLLTLGTAPGVVVSCAIVQVIESPTWRE

SEQ ID NO: 44 - DNA, 3792 bp, Micromonospora carbonacea
  CDS (1)..(3792): evrJ
gtggaagcagagaaggaccggttgcgtccggtggcgtccgaggcggtcgccgtggtggggatcggctgccggttcccgggcgacgtcaactcgcccgacgagttctgggacctgctcaccgggggtcgcaacaccaccgggacggtgcccgaggagcgctggagcgcgtaccgcgacctgggtccggcgttcgagtccgcgctccggtcggccacccgggcgggcaacttcctggccgacatctccggcttcgacgcggacttcttcggcatctccccgcgcgaggccgagctgatggacccgcagcagcggctcatgctggaggtgacctggcaggcgctggaggacgccgggatcccgccccgcaccctggccggcaccgacgtcggcgtcttcgccggcgtgtgcacctacgactacggcggccaccagttggaggacctgccgcacatcgacgcctggacgggcatcggcgccgccacctgcgccgtcgccaaccgggtctcccacgtgctcgacctgcgcgggccgagcctgtcgatcgacaccgcctgctcggcgtcgctggtcgcgttgcacctcgccgcgcagagcctgcggctgggcgagagcacgctggccctcgccggcggggtcaacctgatcgtcacgcccgggcagtcgatcaccctcggctcggccggtgccctggcacccgacgggcgcagcaagtccttcgacgccaccgccgacggctacggtcgtggcgaggggtgcggcgtcctcgtgctcaagctgctctccgacgcccagcgggacggggaccgggtgctggccgtgctgcggggcagcgccgtcaaccaggacggccggaccaacgggatcatggcaccgtgcggccaggcccaggagcacgtgatggtccgcgccctgcgctcggccggcatcgaggccggcagcgtcgactacatcgaggcgcacggcaccggcaccccgctcggtgacccgatggaggccgcggcgatcggctcggtctacgggcaggaccgcccggacgacgagccctgcctgatcggttcggtcaagtccaacatcggccacctggagggcgcggccggcgtcgcaggcgtcatcaaggcggtcctggcgctgaaccgggccgaggtgcccgccaccctgctggtcaccgaggtcaacccggacatcgagtggaagcggctgcggctgcgcctggtcacccgcaaccagccctggccggaccggccggggccgcgccgcgccggagtctccggcttcggctacggcggcaccgtggcgcacgtggtgctggaacaggccccgccggtcgccgccgagccggccccggcgctgaccggcgagacgctgttcccgatctccgccggctccgcgcactcccttcgcgagcgggcccgcgccctggccgggatcgtcccggatgtcgacctcgccgcgctcgggcacaccctggctcggcggcgttcgcacctgacccaccgggcggtggcggtggccgccggccgggacgacctggtcgcggcgttcgcggcgctcgccgacgacaggccgcacgaccgggtgcgtaccggaagcccggtggcggagccgccccgcacggtgtgggtgttctccgggcacgggtcgcagtggacgggcatggggcgggaactgctggccacggagccggccttcgcggacgcgatcgaccgcatcgagcagatcttcctcgacgagatcggtttctcaccccgccaggcgatcctcgacggcgactacgaggccgtcgaccggacccagacaatgatcttcgcgatgcagctcggcctggccgagatgtggcgagcgaggggagtcgagccggacgcggtgatcggccactcggtcggagagatcgccgcggcggtgaccgccggcatcctgaccgtggccgacggcgcacggctgatctgccgtcgttccctgctgctgcgcgaggtcgccggccagggcgcgatggccctggtgacgctgcccttcgaggaggtcgcggccaggctggccggccgcgtcgacgtggtcgccgcgatcgcctcctccccctcgtcgaccgtggtctccggcgacccggccgcgctggacgcgctggtcgccgagtggaccgaggagggcctgggcgtacgccgggtcgcctccgacgtggccttccacagcccgcacatggatccgctgctcgaccggctgcgcgccgccgtcgacttcaccgcccgcgcaccccgggtgccgatctacagcacggcgctggccgacccgcgggccccgatcaccgccgacggcgagtactgggccgcgaatctgcgcaacccggtccggctcgccgcagcggtggccgccgccgtctccgacggacaccgggccttcatcgaggtctccccgcacccggtggtgacccactcgatccacgagacgctggccggaagcctcgacgacgaggtcttcgtcggcggcaccctgcgccgcgacaccccggaggcgcaggccttcctgtccagcctgggggccgcgcactgccacggggtcgcggtcgactggggccgggtgcatccgtccgggccgctggtcaccctgcccggctacccctggcggcaccggagtcactggcactggccgacgccggccgccgccacgggccggggccacgaccccgcgtcgcacaccctgctcggcgcggtcgacaacgtggcgggcagcgacgtgcgggtgtggcgcaccgcactcgacgacgccagccgcccgtacccgggcagccacgccctcaacggcgtggagatcgttccggcggccgtgctggtggagaccctcatggctgccgccgggcggggcgacggccggccgctgctgaccggcttgtcgatgcggtacccgctgatgaccgccgggctgcacgaggtccaggtggtgcgggacggtgccgaggtgcggctggcgtcccgttccgtcgacgcggaggccgacccgagccgggactggctgatccacaccgacgccacggtggccgacgccgacgccacggtgctcgccgcgcgggcgttggccgaccccgacgaccaccggatggaaccgggcgacccgggctccatccaccgccggctcgccgaggtcggggtgccgtcgacgggattcgactggtcggtggaggagctgctctccgggtacggcgtgctccgcgcgcgggtgcgctcggccgactcgtccacctgggcgccggtgctggacgccgtcatgtcggtcgcccccgccgtcttccccggcgtgccgcagctacgcatggtggtgtacgtcgacgaggtgctgctcaccggcgagccaccggaggtgacgctgatcgaggtcgccctcgacccagaccggcccgacacggcgaacgcgctggtcgcggatgctcagggccgggtcgtggccagccttcccgggctgcgctacccggtgatcgaccagccggtcgccccggcgcaggacagttccggcgaggtggaggaggcggtctccttcgccggcctgtccgacgaggaactgcacgagcgggtgttcgacgaggtgcgccggcagatcgccggggagatgcgactcgacgccgacgacctgcatccccgccggccgctggccgagcagggcctcgactcggtgatgacggtggtgatccggcgacgcctggagaagcgcaccgggcggagcctctccccgaccgtcttctggcagcggcccaccgtcgccgccatcgccgaccacctggtggagctgttgagcaccccgcaggag

SEQ ID NO: 45 - protein, 1264 aa, Micromonospora carbonacea
  evrJ
VEAEKDRLRPVASEAVAVVGIGCRFPGDVNSPDEFWDLLTGGRNTTGTVPEERWSAYRDLGPAFESALRSATRAGNFLADISGFDADFFGISPREAELMDPQQRLMLEVTWQALEDAGIPPRTLAGTDVGVFAGVCTYDYGGHQLEDLPHIDAWTGIGAATCAVANRVSHVLDLRGPSLSIDTACSASLVALHLAAQSLRLGESTLALAGGVNLIVTPGQSITLGSAGALAPDGRSKSFDATADGYGRGEGCGVLVLKLLSDAQRDGDRVLAVLRGSAVNQDGRTNGIMAPCGQAQEHVMVRALRSAGIEAGSVDYIEAHGTGTPLGDPMEAAAIGSVYGQDRPDDEPCLIGSVKSNIGHLEGAAGVAGVIKAVLALNRAEVPATLLVTEVNPDIEWKRLRLRLVTRNQPWPDRPGPRRAGVSGFGYGGTVAHVVLEQAPPVAAEPAPALTGETLFPISAGSAHSLRERARALAGIVPDVDLAALGHTLARRRSHLTHRAVAVAAGRDDLVAAFAALADDRPHDRVRTGSPVAEPPRTVWVFSGHGSQWTGMGRELLATEPAFADAIDRIEQIFLDEIGFSPRQAILDGDYEAVDRTQTMIFAMQLGLAEMWRARGVEPDAVIGHSVGEIAAAVTAGILTVADGARLICRRSLLLREVAGQGAMALVTLPFEEVAARLAGRVDVVAAIASSPSSTVVSGDPAALDALVAEWTEEGLGVRRVASDVAFHSPHMDPLLDRLRAAVDFTARAPRVPIYSTALADPRAPITADGEYWAANLRNPVRLAAAVAAAVSDGHRAFIEVSPHPVVTHSIHETLAGSLDDEVFVGGTLRRDTPEAQAFLSSLGAAHCHGVAVDWGRVHPSGPLVTLPGYPWRHRSHWHWPTPAAATGRGHDPASHTLLGAVDNVAGSDVRVWRTALDDASRPYPGSHALNGVEIVPAAVLVETLMAAAGRGDGRPLLTGLSMRYPLMTAGLHEVQVVRDGAEVRLASRSVDAEADPSRDWLIHTDATVADADATVLAARALADPDDHRMEPGDPGSIHRRLAEVGVPSTGFDWSVEELLSGYGVLRARVRSADSSTWAPVLDAVMSVAPAVFPGVPQLRMVVYVDEVLLTGEPPEVTLIEVALDPDRPDTANALVADAQGRVVASLPGLRYPVIDQPVAPAQDSSGEVEEAVSFAGLSDEELHERVFDEVRRQIAGEMRLDADDLHPRRPLAEQGLDSVMTVVIRRRLEKRTGRSLSPTVFWQRPTVAAIADHLVELLSTPQE

SEQ ID NO: 46 - DNA, 1317 bp, Micromonospora carbonacea
  CDS (1)..(1317): evrK
gtgcccccgctgggctcccaccagctactgctgttcctgctccaggtgggcctgctgctgctgctcgccgtcgtcctgggacgggtggcgcaacgcttcggcctgccggcggtggtcggtgagctgctgaccggggtgctgctcggcccctcggtgctgggggccctggcacccgacatcggacggtggctgctgcccgccgaccccgaccaggtccacctgctcgacgccatcggtcagttcggcgtcgtactgctggtcgccgtggccggtctgcacctggacctgcggctggtccggcggcgggccggcacgatcggcgcggtggccgtcggcggcctcgcggtgcccctcggcctgggcatcgccgccggcctgctggccccggcggcgcttctcgcggccgggcaggagcggactgtcttcgcgctgttcgtcggcgtggcgatggcggtcagcgccgtgccggtgatcgcgaagacgctcaccgacatgcgcctgctgcaccgcgacgtggggcagatcatcctggctgcggcgtcgctggaggacgctgcggcctggttcctgctgtcgctcatctcgtcggtggcggtgagcaccctcaccgccgggcaggtggtgaccgccctgctttacctcgtggcctacctcgcggtggccgtcctggtcggccggccggtgacccggcgcgccatgcgctgggcgaacgcccagcccgacggcggggccgccagcgccgtcgccgtggtgatcgtgctggccttcgcggcgggggcgcacgcgctgggcctggaggcgatcttcggcgcgctggtggcgggtgtcctgatcggccttcccggcaacggggagccggcccggctggcaccgctgcgcacggtggtgctgtccgtgctcgccccgatcttcctggccagcgcggggctccgggtcgatctgcgtgccctcgccgacccggaggtgctcgccgccggggcggtgatcctggcgctcgccgtgctcggcaagtacaccggcgcgtacctgggtgcacggctggcccggcagagccactgggagggcgtcgccctcggcgccgggctcaacgcgcgcggtgccgtggagatcatcatcgcgatggtcgggctgcgcctgggcgtgctgaacaccgcctcatacaccatcgtggtgctggtcgcggtcgtcacctcggtcatggcgccgccgatgctgcgcgtcgccatgcggcgggtcgaacagaacgccgaggagaccctgcgggagagccgccacctggagtgggccgccacccctgcggtggaccagcggccgggc

SEQ ID NO: 47 - protein, 439 aa, Micromonospora carbonacea
  evrK
VPPLGSHQLLLFLLQVGLLLLLAVVLGRVAQRFGLPAVVGELLTGVLLGPSVLGALAPDIGRWLLPADPDQVHLLDAIGQFGVVLLVAVAGLHLDLRLVRRRAGTIGAVAVGGLAVPLGLGIAAGLLAPAALLAAGQERTVFALFVGVAMAVSAVPVIAKTLTDMRLLHRDVGQIILAAASLEDAAAWFLLSLISSVAVSTLTAGQVVTALLYLVAYLAVAVLVGRPVTRRAMRWANAQPDGGAASAVAVVIVLAFAAGAHALGLEAIFGALVAGVLIGLPGNGEPARLAPLRTVVLSVLAPIFLASAGLRVDLRALADPEVLAAGAVILALAVLGKYTGAYLGARLARQSHWEGVALGAGLNARGAVEIIIAMVGLRLGVLNTASYTIVVLVAVVTSVMAPPMLRVAMRRVEQNAEETLRESRHLEWAATPAVDQRPG

SEQ ID NO: 48 - DNA, 939 bp, Micromonospora carbonacea
  CDS (1)..(939): evrL
atgcgccggacccggctggcgatgctggccggggagcgggtcgacgcctgctcctactgctaccaccgcgaggaccacggcgcgctgtcgtaccggcaggagatcaaccagcggttccgggacatcgccgaccccgaccggctggccgcccgcaccgcgcccgacggcaccgtcgaggacttcccgttcttcctcgacatccggttcggcaacacctgcaacctgcggtgcgtgatgtgcgcgtacccggtcagctcgggctggggcgccaagaagcggccggcctggtcgtccgcggtcatcgacgcctaccgggacgacgacgagctgtggcagaccctgcgcgagaacgcccacctcatccggcggctgtacttcgccggtggggagccgttcatgcagccgggccacttcgccctgctcgacctgctggtggagacgggtaacgccggcaacgtcgacgtcgtctacaactccaacctcaccgtgttgccggagtcggtcttcgaccggttccggcacttcaagagcatcggcatcggcgcctcctgcgacggctacggcgaggtgttcgagcggatccggcagggcgcgaagtgggagaccttcatcgcgaacgtccgccgggcccgctcggaggtcaacctctggctccaggtggcaccccagcgggacaacgtctgggggctgcgcgacctgctggagttcgcccgggccgaggggctcgacgtggacctggccaacgtggtgcagtggccggccgagatgtcggtgctcagcctgcccgaggaggacaaggttcgggccaccggggagctgacctccctcatcgattggtgcgccgggctgggctgggagaagcccgccgccgacctgcgggccctgcggaccttcatgaactcggccgacccggtggacctgccgcccgagatcgcggcc

SEQ ID NO: 49 - protein, 313 aa, Micromonospora carbonacea
  evrL
MRRTRLAMLAGERVDACSYCYHREDHGALSYRQEINQRFRDIADPDRLAARTAPDGTVEDFPFFLDIRFGNTCNLRCVMCAYPVSSGWGAKKRPAWSSAVIDAYRDDDELWQTLRENAHLIRRLYFAGGEPFMQPGHFALLDLLVETGNAGNVDVVYNSNLTVLPESVFDRFRHFKSIGIGASCDGYGEVFERIRQGAKWETFIANVRRARSEVNLWLQVAPQRDNVWGLRDLLEFARAEGLDVDLANVVQWPAEMSVLSLPEEDKVRATGELTSLIDWCAGLGWEKPAADLRALRTFMNSADPVDLPPEIAA

SEQ ID NO: 50 - DNA, 1236 bp, Micromonospora carbonacea
  CDS (1)..(1236): evrM
gtggtcgagcggaccacctgccgggtgtgtggcgggaccctgcgtacggtcctcgacctcggtgcccagtacctacagggcagcttcgtgaagcccggcgtgtcggacccgcccagggtgcgcttccccctggagctgacccggtgcgcggaacgcgacggcggtgacccgtgcggcctggtgcagttgcggcacaccctgccgggtgggctgctctacgacacctactggtaccgctcgcggatcaacgacacgatgcgccggcatctcgccgacgtcgtggacgcggcggtcgaggtgttgggggagcggcccggcaaggtgctcgacatcggctgcaacgacggcaccctgctgggcaacctgaccgacgcgcagcggtggggcatcgacccctccagcgccgccgacgacgcgcccgacgacttcaatctgatccgcgacttcttccccagccccgagctggtcccgcacgcgggcagcttcgacctggtcacctcgatcgcgatgttctacgacgtcgaggacccggtggagttcgcccgtcaggtcgaggcgctgctcgccccgggcggggtctgggtggtcgaggtcgcctacctgccggcgatgctggagatcgccggctacgacagcatctgccacgagcacctgtcctactactcgctggccacgctgagccgcattctgggcgcggcgggcctggagatcgtccgtgccagcctcaacggggtgaacggcggctcgatctgctgcgtggtcacccgggccggtgaggtgggcggccgggccgacggttcggtcaaggcactcgccgaccgggagctggcgctggggctggacggcgacgccccgtaccagcgcttcgccgagcaggtgcgccagcaccgtgacgaggtgagcgccctgctgcgcgagctgcggggccagggccgcacggtgcacgtctacggcgcgtcgacgaagggcaacaccctcctgcagttctgcggcatagaccgcgagctcatccggtacgccgcggagcgcaatccggacaaggtgggcgcgcgcaccctcggcacggacatcgaaatcatcagcgagcaggagtcgcgggcggcccgcccggactactacctggtcctgccctggcacttccgggacgagatcgtcgcccgggaggcggagatgctggccagcggcacccggttgatctttccgctgccccgggtcgagacggtcggccgaccggga

SEQ ID NO: 51 - protein, 412 aa, Micromonospora carbonacea
  evrM
VVERTTCRVCGGTLRTVLDLGAQYLQGSFVKPGVSDPPRVRFPLELTRCAERDGGDPCGLVQLRHTLPGGLLYDTYWYRSRINDTMRRHLADVVDAAVEVLGERPGKVLDIGCNDGTLLGNLTDAQRWGIDPSSAADDAPDDFNLIRDFFPSPELVPHAGSFDLVTSIAMFYDVEDPVEFARQVEALLAPGGVWVVEVAYLPAMLEIAGYDSICHEHLSYYSLATLSRILGAAGLEIVRASLNGVNGGSICCVVTRAGEVGGRADGSVKALADRELALGLDGDAPYQRFAEQVRQHRDEVSALLRELRGQGRTVHVYGASTKGNTLLQFCGIDRELIRYAAERNPDKVGARTLGTDIEIISEQESRAARPDYYLVLPWHFRDEIVAREAEMLASGTRLIFPLPRVETVGRPG

SEQ ID NO: 52 - DNA, 759 bp, Micromonospora carbonacea
  CDS (1)..(759): evrN
atggccgaacggttccgggagcggatcgagccccggcccggggactgggcatacgcccacttcctggacctgcgcgacgcgctggcggaggcggtccgggacgccacgggagtctggctcgactacggcgcgggcacctcgccataccggggcctgttccgctccgccgagttgcagaccgccgacatcccgggcggtgagtccctgccggccgaccacgccctcgaccgggacgggcgctgcccggtgccggacgggacgttcgacggggtgctctccacccaggtgctcgaacacgtctcggacgcggacgcgtacctgcgggaggcgtaccggctgctgcgcccgggcggccggctggtgctctccacccacggggtgtgggaggagcacggcggccaggacctgtggcggtggaccgccgacgggctggcccgccaggccgagtgggccggcttcaccgtcgaccgcaccgtcaagctgacctgcgggccgcgcggcctgttgctgctgctgcgctggtacggccgcgagcacggctggccgtccggcggcccggtgggtctggccctgcgcgccctgtggctggtggaccggctgcggccccgcgcgctcgacgagtacctcgaccgggcgttccggcatctcggccgcagcgagggccccgaccagcccttctatctggacatcctgctggtcgccagcaaaccgcacgacggggcgcctggtcccgcacaccggcacgagacgaggaggacc

SEQ ID NO: 53 - protein, 253 aa, Micromonospora carbonacea
  evrN
MAERFRERIEPRPGDWAYAHFLDLRDALAEAVRDATGVWLDYGAGTSPYRGLFRSAELQTADIPGGESLPADHALDRDGRCPVPDGTFDGVLSTQVLEHVSDADAYLREAYRLLRPGGRLVLSTHGVWEEHGGQDLWRWTADGLARQAEWAGFTVDRTVKLTCGPRGLLLLLRWYGREHGWPSGGPVGLALRALWLVDRLRPRALDEYLDRAFRHLGRSEGPDQPFYLDILLVASKPHDGAPGPAHRHETRRT

SEQ ID NO: 54 - DNA, 942 bp, Micromonospora carbonacea
  CDS (1)..(942): evrO
atgagcgcgactgtggacgtccgcaccgagcaggccgtccccgagtgccacatccacgagaccgggctgcttccggagcacctgaccgccttccgccggcagggcgcgctgatcctgcgcgggctgctggaccccgacgagctgcggtccgtgcaggcggcggccgacgagctgatcgacgaagcctggcgcacccggacgatgaccgacaccatctggacgctggaaccgcacgagccggacgcggcgccggtgcggatcgagtacgtggtcgacaagtccccggtggtcgcccggctcgccggccaccccctgctgctgcgggcgatggaggacctggtcggccccaacctcatccccacctgggacagcatggtcttcaagaccgaggcgggggcgccccggctgccctggcaccgcgacggcggcctctacccggagaacgcggtcggcatcaccggcgcgggccgggtgatcgacgtcggcatctaccttgacccggccccggaggacaactgcgtctggtgcatcccgcagtcgaactactgggacaccgaccgggcgaacgagaccaccacccggatgaacgccaccgagtgggacaccaccggggcggtgccggcggtgatgaacccgggcgacgtgatgctgcacaacatcctgatgctgcacgccgcgccggcggtgaccggcaagcggcgccgggtcatctacttcgagtaccggcccgccgaggtcgagctggacctcggcccgcacgtgccggagtacatcgggctcaagcagcaggtgctgctctcctgcctggcgcagcggcgggcggcaccggagcacgccggcgagcagcccttcgagtaccggcccgccgcgtcgctgcggcgctgggagggcctgccggagccgaccaccatgcggtacccgcacgaggagtactggcgttgg

SEQ ID NO: 55 - protein, 314 aa, Micromonospora carbonacea
  evrO
MSATVDVRTEQAVPECHIHETGLLPEHLTAFRRQGALILRGLLDPDELRSVQAAADELIDEAWRTRTMTDTIWTLEPHEPDAAPVRIEYVVDKSPVVARLAGHPLLLRAMEDLVGPNLIPTWDSMVFKTEAGAPRLPWHRDGGLYPENAVGITGAGRVIDVGIYLDPAPEDNCVWCIPQSNYWDTDRANETTTRMNATEWDTTGAVPAVMNPGDVMLHNILMLHAAPAVTGKRRRVIYFEYRPAEVELDLGPHVPEYIGLKQQVLLSCLAQRRAAPEHAGEQPFEYRPAASLRRWEGLPEPTTMRYPHEEYWRW

SEQ ID NO: 56 - DNA, 726 bp, Micromonospora carbonacea
  CDS (1)..(726): evrP
atgaacgactggtacgaccagctcaccgtggcgctgatcgagcagatctgcgaaccggacgccaacaccgtggacatcggggccggcgccggcgacatcctgcgtcacctgctgcgggtcgccccccgtggccggcacgtggccgtcgaggcgctgccgtcgtacgccgaggggctgcgccgggacttccccggcgtgacggtggtggccgccgccgccgccgagcgcaccggccgggacagcttcgtccacgtggtctccaaccccggctacagcgggctgcgccggcgtccctacgaccgcccggacgagaccctgcgggagctgacggtcgacaccgtccgcctggacgacgtgctccccggtgaccgccggatcgacctggtcaaggtggacaccgagggcggcgaggtgctcgccctgcgcggtgccgtggagctgctccgccgctggcggccggtgatcgtcttcgagcacggcggcgaccacgccatgcgggagtacggcaccaccagcgccgacctgtgggcgctgctcgtgaccgagctgggttacgagctgcgtaccctgcccgggcgccgcgccgggcagccggcgctggaccgggcggggttcgccgacgcgctgcgggagcactggtacttcgtcgccgaccgaccgagcccgggcccggccggcggctccgggcagcacgaaccgtccgcctggcagaagggaaccgaacca

SEQ ID NO: 57 - protein, 242 aa, Micromonospora carbonacea
  evrP
MNDWYDQLTVALIEQICEPDANTVDIGAGAGDILRHLLRVAPRGRHVAVEALPSYAEGLRRDFPGVTVVAAAAAERTGRDSFVHVVSNPGYSGLRRRPYDRPDETLRELTVDTVRLDDVLPGDRRIDLVKVDTEGGEVLALRGAVELLRRWRPVIVFEHGGDHAMREYGTTSADLWALLVTELGYELRTLPGRRAGQPALDRAGFADALREHWYFVADRPSPGPAGGSGQHEPSAWQKGTEP

SEQ ID NO: 58 - DNA, 1026 bp, Micromonospora carbonacea
  CDS (1)..(1026): evrQ
gtgcggcagcgctgcatcggtgagcgggggccgctggtctcggcgctcggcctgggcacctgggcgctcggcggccagtggggccggcggatcgaaccaggcgtgcaggccgtccgccgggccttcgacctgggcgtcacccttttcgacacctcccgggcgtacggcggcggggccgccgaggcggcccttgcccgcgggctggccgacctgttgcccgcgcaccgggacgagatcgtgatcgccacggccggcgggctggagacccggcccggcgtgcgacggcacaagctcgacccgcccggacggacggtgcgtaacagcgaccccgcgttcctccgggacgagctgctggccagcctgcgtcagctcggcacggaccacgtcgacgtgtactccgtgcactggcccgacccgaccgtcccgctcgcggagaccgccgaggtgctggcggggttcgtgcgcgagggcctggcccgccatgtcggcttcgccaacgtgacggcgggcgacctggccgagctggtgccgaccgggctgctggacgtcgtccaggtgccgttcaacctgctcgaccgtggtgccgagaaggaggtgctgccccgctgccaggaggccggcgtcggggtgctgggcggctccgcgctcgcccacgggctgctcaccggcgcgctgcaccgcgaccaggcattcgcccccgaggactggcgggcctactcgcacgccttccggggtgaggactacgcccaactgctcgacgtggtcgacggcctcgccgccttcgccgccgagcgtgggcacaccgtcgcgcaggtggcactggcctgggcgctgcaccacccggccggggtggtgccggtgttcggcgctcagtcgcccggagtcgtcgaggagaacgtccgcgccgccggcctggagctgtccgagatcgagctgcgggagctggaactcctggtccgtaccgccccggcggtcggctccggggccggaccggcgtgccggaccgaggagcgtgacgatgtccac

SEQ ID NO: 59 - protein, 342 aa, Micromonospora carbonacea
  evrQ
VRQRCIGERGPLVSALGLGTWALGGQWGRRIEPGVQAVRRAFDLGVTLFDTSRAYGGGAAEAALARGLADLLPAHRDEIVIATAGGLETRPGVRRHKLDPPGRTVRNSDPAFLRDELLASLRQLGTDHVDVYSVHWPDPTVPLAETAEVLAGFVREGLARHVGFANVTAGDLAELVPTGLLDVVQVPFNLLDRGAEKEVLPRCQEAGVGVLGGSALAHGLLTGALHRDQAFAPEDWRAYSHAFRGEDYAQLLDVVDGLAAFAAERGHTVAQVALAWALHHPAGVVPVFGAQSPGVVEENVRAAGLELSEIELRELELLVRTAPAVGSGAGPACRTEERDDVH

SEQ ID NO: 60 - DNA, 492 bp, Micromonospora carbonacea
  CDS (1)..(492): evrR
atggcggccgggctcgccgaccgggtgcgcgccgtgctctgcgccgacgtcagccgatccttcctcgacaaggcgcgcgccacctgcgagggccgggagaacgtctcctaccaccacatcgagaacgacttcctggagaagctgccgaccgccgcgttcgacgccgggttctccctgaacgtgttcatccacctcaacgtcttcgaggtcttcctctacttccgtcagatccggcggatcctgcggcccggcgggctgttctgcttcaacttcctggacctcggcgacaacacgcgcggcttcttccacacctacgccgagcggtaccgcgacgcgaaccccgtggagttcaaggggttcctgaactggcacggcgtggagttgatgaccggcatcgccgccgaggccgggctgacgccggtcaccgacaagatgatcaatcacgacggcgtggtgttcctgacgctgcgcagcgacggggagccggcggcg

SEQ ID NO: 61 - protein, 164 aa, Micromonospora carbonacea
  evrR
MAAGLADRVRAVLCADVSRSFLDKARATCEGRENVSYHHIENDFLEKLPTAAFDAGFSLNVFIHLNVFEVFLYFRQIRRILRPGGLFCFNFLDLGDNTRGFFHTYAERYRDANPVEFKGFLNWHGVELMTGIAAEAGLTPVTDKMINHDGVVFLTLRSDGEPAA

SEQ ID NO: 62 - DNA, 1269 bp, Micromonospora carbonacea
  CDS (1)..(1269): evrS
atgaaggttctgttcaccgtgtccaactgggccgggcactacatgtgcatggtgccgctggcctgggcgctgcgggcggccggccacgacgtcaaggtcgcctgttcgccgtcccaggtccggggcgtggccgcggcgggcatgatgcccgtctcggtgctcgacggacccgacatgatggagagcgcccggctgggcttctacgtccaggccctctacaccccgcagcacatggtggagcaaccgctgccgttgaaccccttcacgggccggccgatggactcgctcgccgacttcgacaccgacctgctcgccgactactggaagcgcacggtcaccgcggtccagcgcagctacgacaacgcggtcgactacgccgcccactaccggcccgacctggtggtccacgacatcatggccgtggagggcgcgctggtcgccgagctgcaccacatccccagcgtctacttctcgcccgggttcatcggcaccatcgagaccgagcccgggctcgacctggtctccggcgacccggtgaccgagttccgcaagtacggcgtcgagtggagccggcaccagatccggtacgccatcgacccgtcgcccgacgtggcgatcccgccgatgggcgacgcgctgcggatcccgatccgctaccagccctacaacggctcccaggacgtggacccctggctgctcggtccgcgccggggcaagcgggtctgcgtggtgtggggcaactccgccacgggcgtgttcggcgcgcaggtgccggcgctgcggcacgccgtcgacgccgccgcccagcggggcgtggaggtcgtgatcaccgccgcctcctccgaggtggaggggctgggcgcgctgccgccgaacgtgcgggtgctcagcaactgcccgctggagctcatcctccccgactgcgacttgctggtgcaccacggcagcgccaactgctacatgaacgggctcgccatgggcgtgccgcagttgtcgctggcgctcaactacgacgccctgatctacgggcggcggctcgacccgcagggcgcgacgaagacgctgcccggcctgaaggcgtcccgcgaggaggtcgacgaggccctcggctccgtcctctacgaccaccgattccgggtggcggcgcagcggatgcgggagtccgtcaccaccgggccgaccgccgtccaggtggccgaactcctggcccggctggccgacaccggcgcgctgagccccgaggacgtcgccgagttcgcccggcgtccg

SEQ ID NO: 63 - protein, 423 aa, Micromonospora carbonacea
  evrS
MKVLFTVSNWAGHYMCMVPLAWALRAAGHDVKVACSPSQVRGVAAAGMMPVSVLDGPDMMESARLGFYVQALYTPQHMVEQPLPLNPFTGRPMDSLADFDTDLLADYWKRTVTAVQRSYDNAVDYAAHYRPDLVVHDIMAVEGALVAELHHIPSVYFSPGFIGTIETEPGLDLVSGDPVTEFRKYGVEWSRHQIRYAIDPSPDVAIPPMGDALRIPIRYQPYNGSQDVDPWLLGPRRGKRVCVVWGNSATGVFGAQVPALRHAVDAAAQRGVEVVITAASSEVEGLGALPPNVRVLSNCPLELILPDCDLLVHHGSANCYMNGLAMGVPQLSLALNYDALIYGRRLDPQGATKTLPGLKASREEVDEALGSVLYDHRFRVAAQRMRESVTTGPTAVQVAELLARLADTGALSPEDVAEFARRP

SEQ ID NO: 64 - DNA, 672 bp, Micromonospora carbonacea
  CDS (1)..(672): evrT
atgaccaccatgtcgcgggagcgcgaggccgtggccagccggttccgcagcgacgggatcgcgcacgtcgggccggtgctcgaccccgaggtgctggcccagctcaaggccggcgcggtaagcctgatcgaccggttcgccggtccggcgcgggccaacgccgactactggaactacgaggtcgagggcgcggagccggtgctgtaccggatccacaacctcgaaaagcaggactggccgcagggcgagttgctgcaccggccggagatcgccgcggtggccgccgacgtcctcggcaccccggtcgtgcccaccgccttcgcgttggtgctcaaggagccactgcgggcggccggcgtgccgtggcaccgggaccgggtcaacgtccccccgcacgcggtctgcaacatcagcatctgcctggacaccgccgggccggagaacggctgtctggagggcgtgcccggctcccacctgctgcccgacgacgccgacgtcacggccgtgcgcgacgccgggccgcgggtgccggtcccctcgcaggagggggacttcatcgtccacgacgtacggctggtgcacggctccgggccgaacccctccgaccagtggcggcgcaccatcgtgatcgagttcgccgatcccgcgcgggagttgccggtcctgacctcc

SEQ ID NO: 65 - protein, 224 aa, Micromonospora carbonacea
  evrT
MTTMSREREAVASRFRSDGIAHVGPVLDPEVLAQLKAGAVSLIDRFAGPARANADYWNYEVEGAEPVLYRIHNLEKQDWPQGELLHRPEIAAVAADVLGTPVVPTAFALVLKEPLRAAGVPWHRDRVNVPPHAVCNISICLDTAGPENGCLEGVPGSHLLPDDADVTAVRDAGPRVPVPSQEGDFIVHDVRLVHGSGPNPSDQWRRTIVIEFADPARELPVLTS

SEQ ID NO: 66 - DNA, 687 bp, Micromonospora carbonacea
  CDS (1)..(687): evrU
gtgaatggattcgagcacgacggagtgcgttacgccgagggctcccagcacggttatctgctgagccagtccccggccgaccgggccgcgaagttcttcggtgcgtttcccgacgcgcggcggatcctcgaactcggcgcactggagggcgcggacacgcttgccctcgcccggcaccccggcacgacggtgcttgccctggagggccgtccggagaacctgcgccgcgcggagctggtgatggaggtcaacggcatcaccaacgtggagctgcgcgtcgccgacgtggagcggatcgacttcaccgagctgggcgagttcgacgccgtcctctgcgcgggcctgctctaccacgtgcgtgagccgtggaccctgctgaaggacatcgcgggcgtcgcggcgggaatctacctctccacccactactggggaggcgtgggcgacctgcaaccgatcgacggctacacggtcaagcaggtccgcgaggagcaccccgagccgcaggcccgggggctcagcgtcgacgtgcgctggctcgaccgggagtccctgttcgccgccctgcacaacgccggcttcgccgaggtggaggtgctgcacgagcgccggtcgccggaggtgtgcgacatcatcgccgtcggccgccgcaccggcacgcgccgaccgaccgaaggggtgagcctccga

SEQ ID NO: 67 - protein, 229 aa, Micromonospora carbonacea
  evrU
VNGFEHDGVRYAEGSQHGYLLSQSPADRAAKFFGAFPDARRILELGALEGADTLALARHPGTTVLALEGRPENLRRAELVMEVNGITNVELRVADVERIDFTELGEFDAVLCAGLLYHVREPWTLLKDIAGVAAGIYLSTHYWGGVGDLQPIDGYTVKQVREEHPEPQARGLSVDVRWLDRESLFAALHNAGFAEVEVLHERRSPEVCDIIAVGRRTGTRRPTEGVSLR

SEQ ID NO: 68 - DNA, 1026 bp, Micromonospora carbonacea
  CDS (1)..(1026): evrV
atggttcgttgtctggtgactggtggtgccggattcatcggctcgcacctggtggagtcattggtcaggaatgggcaccgggtcaccgttctggacgacctcagcggcggcagccggcagcgggttccggccggggtggacctggccgtcggttcggtgaccgacgtggacttcgtcgattcactgttcgccgagaaccgattcgagcgggtcttccactttgccgccttcgcggcggaggcgatcagccattcggtgaagcagctcaactacggcaccaatgtgatgggcagcataaatctgatcaacgcgtcgctgcgtaccggcgtgcggttcttctgtttcgcctcctccgtggcggtctacggccacggcgagacgccgatgcgcgagtccgtcgtccccgtccccgcggacagctacggcctggccaagtacctggtcgagcgcgagctggaggtgacgatgcggacccaggggctgcccttcaccgccttccgcatgcacaacgtctacggcgagtggcagaacatgcgggacccgtaccgcaacgcggtcgccatcttcttcaaccagatcctgcgaggcgagccgatcaccgtgtacggcgacggcggccaggtccgcgcgttcacgtacgtcggtgacgtggtgaacgtggtcagccgcgccgccgagaccgaggccgcgtgggggcgggcattcaacgtgggctcgtcgagcaccaacaccgtgctggagctggcccaggcggtacggtcggcggccggcgtgccggagcatccgatcgcccacctgccgtcgcgggacgaggtgcgaaccgcgtacaccgcgacggagctggcccgatcggtcttcggcgactggacggacaccccgctggccgagggactggcccgcaccgccaggtgggcggccgacgccgggccggcggaactccagtcgtccttcgatatcgagatcggcggggaccggattccggaatgggcccggctggtcaacgaaaggctcagcacggcgagccgc

SEQ ID NO: 69 - protein, 342 aa, Micromonospora carbonacea
  evrV
MVRCLVTGGAGFIGSHLVESLVRNGHRVTVLDDLSGGSRQRVPAGVDLAVGSVTDVDFVDSLFAENRFERVFHFAAFAAEAISHSVKQLNYGTNVMGSINLINASLRTGVRFFCFASSVAVYGHGETPMRESVVPVPADSYGLAKYLVERELEVTMRTQGLPFTAFRMHNVYGEWQNMRDPYRNAVAIFFNQILRGEPITVYGDGGQVRAFTYVGDVVNVVSRAAETEAAWGRAFNVGSSSTNTVLELAQAVRSAAGVPEHPIAHLPSRDEVRTAYTATELARSVFGDWTDTPLAEGLARTARWAADAGPAELQSSFDIEIGGDRIPEWARLVNERLSTASR

SEQ ID NO: 70 - DNA, 987 bp, Micromonospora carbonacea
  CDS (1)..(987): evrW
atgcgtcgcgtcctggtcaccggcggtgccggtttcatcggctcgcagtacgtccgcgacctggccaccggtgcctaccccgacacggcgcaggcccgggtgacggtgctggacaagctgacgtacgcgggcaacctcgccaacctcgaaccggtccaggaccggatcaccttcgtccagggcgacgtctgcgacacggcgctgctggccgaggtgctgcccgggcacgacgtggtggtcaacttcgccgccgagtcgcacgtcgaccggtccatcgccgactcggcggagttcgtccgcaccaacgtgcagggcgtccagacgctcatgcaggcgtgtctcgacgccggggtcgcccgggtggtccaggtctccaccgacgaggtctacggcagcatcgacgagggttcctgggccgaggacacccccctggcgccgaactccccgtacgcggcggcgaaggccggcggggacctgatcgccctggcctacgcccgcacccacgggctgccggtctgcctcacccggtgcggcaacaactacgggccgtaccagtttccggagaagctgatcccgctgttcgtcaccgagctgttgaacgggcgacgggtgccgctgtacggcgacggcgggaacgtccgcgactggatccacgtgacggaccactgccggggcatccagaccgtcgtcgaccgcggtgtccccggcgaggtctaccacatcgccggcacggctgagctgtccaacatggagctgaccgggcggctgctggacgccttgggggccgggtgggaccgggtcgagcgggtgccggaccgcaagggccacgaccgccgctactcgctgacggacgcgaaactgcgggcgctcggctaccggcccgaggtcgccttcgccgacggcctggccgagacgatcgactggtaccggacgcaccgggactggtgggagccgctgaagaagcaggccgaccggtcgccggtgccc

SEQ ID NO: 71 - protein, 329 aa, Micromonospora carbonacea
  evrW
MRRVLVTGGAGFIGSQYVRDLATGAYPDTAQARVTVLDKLTYAGNLANLEPVQDRITFVQGDVCDTALLAEVLPGHDVVVNFAAESHVDRSIADSAEFVRTNVQGVQTLMQACLDAGVARVVQVSTDEVYGSIDEGSWAEDTPLAPNSPYAAAKAGGDLIALAYARTHGLPVCLTRCGNNYGPYQFPEKLIPLFVTELLNGRRVPLYGDGGNVRDWIHVTDHCRGIQTVVDRGVPGEVYHIAGTAELSNMELTGRLLDALGAGWDRVERVPDRKGHDRRYSLTDAKLRALGYRPEVAFADGLAETIDWYRTHRDWWEPLKKQADRSPVP

SEQ ID NO: 72 - DNA, 1065 bp, Micromonospora carbonacea
  CDS (1)..(1065): evrX
gtgaaggcgctggtcctggcgggaggggtgggatcgagattgcgtccgatcacccacacgtccgccaaacaactcattcccgtggccaacaagccggtgctgttctacgggctcgaggctattcgtgagggcggtatcgaggaggtgggcatcgtcgtcggcagcaccgcgcccgaaattcagcgcgtggtcggcgatggttcccagttcggcctccaggtgacctaccttccgcaggaggctccccgggggctggcgcacgccgtgctcatctcccgcgactacctcggcgacgacgacttcgtcatgtacctcggcgacaacttcatcgtcggcgggatcaaggacatcgtcgagcgcttccggcaggagcgaccgcacgcgcagatcatgctgacccgggtcgccgacccgcacgccttcggcgtcgccgagatgggcgcggacggccgggtgatcggggtggaggagaagcccgagcaccccaagagcgacctggccctggtcggggtctacgtcttcagcccggtggtccacgatgccgtggccgagctgaagccgtcctggcgcaacgagctggagatcaccgacgcggtgcagtggatgatcgaccgcggccaccgggtcgactccaccatgatcacgggctactggaaggacaccggcaacctcgccgacatgctggagatgaaccggttcgtcctcggcagcgtcgagcctttggtcgagggcaaggtcgacgaccgcaccgaactgatcggcccggtggtgatcagcgccggcgccgacgtcagcggctcccggatcgtcggcccggtggtggtcggagccggctcgatcatccgcaactcctacctcggcccgtacacctcgatcgactgcgactgcaccctgctggagaccgagatcgagcactccatcgtgctgcgcggtgcctacatcgagggcatcggccgcatcgagttctcgatgatcggccgggaggcgcgggtggtccccgggccccgggtgcccaagacgcaccggttcgtcctcggcgatcacagcgaagtccgggtgggggtc

SEQ ID NO: 73 - protein, 355 aa, Micromonospora carbonacea
  evrX
VKALVLAGGVGSRLRPITHTSAKQLIPVANKPVLFYGLEAIREGGIEEVGIVVGSTAPEIQRVVGDGSQFGLQVTYLPQEAPRGLAHAVLISRDYLGDDDFVMYLGDNFIVGGIKDIVERFRQERPHAQIMLTRVADPHAFGVAEMGADGRVIGVEEKPEHPKSDLALVGVYVFSPVVHDAVAELKPSWRNELEITDAVQWMIDRGHRVDSTMITGYWKDTGNLADMLEMNRFVLGSVEPLVEGKVDDRTELIGPVVISAGADVSGSRIVGPVVVGAGSIIRNSYLGPYTSIDCDCTLLETEIEHSIVLRGAYIEGIGRIEFSMIGREARVVPGPRVPKTHRFVLGDHSEVRVGV

SEQ ID NO: 74 - DNA, 744 bp, Micromonospora carbonacea
  CDS (1)..(744): evrY
atgacgacccccctgccccgtccgatcgacgccgtcctgttcgacttctccggcacgctgttcgccgtggaactgccgcagcgttggctgcgggcggcggcggccaccgtcggcgtccagctcgacccggcgcagcaggaggccctgaccgggttgctgctggcggccggccgtcccggcgggccggagccgcacgccgtcccgccggggctcgccgaggtgtacgcccgccgggacctctcgcccgaaacgcaccgcagcgcgtacgtgggcctgctctccaccgtcgacctgccccatcccggcctcgccgaggcgctctacgaccggctgttccgcacggacggctggctgccctaccgcgacgccgccccggtcctggcggagttgcgccggcgcggcgtgggcaccgccgtggtcagcaacatcgcctgggacctgcggcccaccttcgcggcgtacgggatggcggagctggtggacgcctacgtcttctcccacgaggtgggggcggtcaagcccgatccccggatcttccgcaccgcctgcgacgagctgaaggtcgccccggagcgggcgctgatggtgggcgacaccctggccgacggtggggcggtgtacgccggcctgcagaccctgctgctgccggccagcccgccggacaccgtgcacggcctggccgccgtgctcgaactggtcggcggcgggccggccaggcccccgtttgcggaaatggcggacgca

SEQ ID NO: 75 - protein, 248 aa, Micromonospora carbonacea
  evrY
MTTPLPRPIDAVLFDFSGTLFAVELPQRWLRAAAATVGVQLDPAQQEALTGLLLAAGRPGGPEPHAVPPGLAEVYARRDLSPETHRSAYVGLLSTVDLPHPGLAEALYDRLFRTDGWLPYRDAAPVLAELRRRGVGTAVVSNIAWDLRPTFAAYGMAELVDAYVFSHEVGAVKPDPRIFRTACDELKVAPERALMVGDTLADGGAVYAGLQTLLLPASPPDTVHGLAAVLELVGGGPARPPFAEMADA

SEQ ID NO: 76 - DNA, 750 bp, Micromonospora carbonacea
  CDS (1)..(750): evrZ
gtgacccgtacccgaaccgccctgcgccggctgctcgccgccggtctggccagcctcgccaccgctgccgcgaccctcgtcgccaccgccggcccggcggcggccgccaccacccccggcatcgacgtgtcccactaccagggatcgatcaactggacgagcgtccgcaacgcgggcatccagttcgcgttcatcaaggccaccgagggtacgagctacaaggaccccaacttcaacgccaactacgtcaactcctacaacgccggagtgatccggggggcgtaccacttcgcccggccgaacatctcctccggcgccacccaggccaactacctggccagcaacggcggcgcctggtcggcggacagtcgcaccctgccggccgcgctggacgtcgaggccaacccgtacagcggcggcacgtgctacggcctcagcacgtccgggatgcgtagctggatccaggacttcctgaacacgtacaaggcccgcaccggccggtacgcggtcatctacaccaccacgagctggtggaaccagtgcaccggtagctggaccgggccgtgggccaaccacccgctgtggctcgcccgctggtcgagcaccccgggcaccctgccggccggcgcttcggtctggagcttctggcagtacacggcctccggcagcgtctccgggatcagcggcaacgtcgaccgcaacaactggaacggcgaccgcacccggctgatcgcgctggcgaacaacacc

SEQ ID NO: 77 - protein, 250 aa, Micromonospora carbonacea
  evrZ
VTRTRTALRRLLAAGLASLATAAATLVATAGPAAAATTPGIDVSHYQGSINWTSVRNAGIQFAFIKATEGTSYKDPNFNANYVNSYNAGVIRGAYHFARPNISSGATQANYLASNGGAWSADSRTLPAALDVEANPYSGGTCYGLSTSGMRSWIQDFLNTYKARTGRYAVIYTTTSWWNQCTGSWTGPWANHPLWLARWSSTPGTLPAGASVWSFWQYTASGSVSGISGNVDRNNWNGDRTRLIALANNT

SEQ ID NO: 78 - DNA, 2076 bp, Micromonospora carbonacea
  CDS (1)..(2076): evsA
atgggtcgggtatggaaggcgcgcgacgaggtgctgcaccgggatgtggcgatcaaggaactggtcccgccgcccagcctcaccccggaggagcgccgcgagatgcgggaacgctcgctgcgggaggcccgtgccatcgcgcgactcaaccacgtcaacgtggtccgcatcttcgacgttctgcgcaccgacggcgacccgtggatcgtcatggagtacgtggcgtcgaagtcccttcaggacactctcgcggaggacgggccggtgtcgccggccaaggcggtcgagatcggcctgggggtgctcggcgcgctgaaggcggcgcacaaggccggcgtcatgcaccgggacatcaagccgggcaacgtgctgctcggcaccgacggccgggtggtgctgaccgatttcggcctggcgaccatccccggtgacccgaacgtgacgcggaccggaatggtgctgggctccccggcgtacatcgccccggagcgggcgcgggacggcaccgccggcccggaggcggacctctggtcgctgggcgcgacgctctacgcggcggtggagggcaagtcgccgttcgcccgaccgtcggcgatcgccaccctggcggcgctggccaccgagccgatgccgccgccgaggaacgccggcccgttgaagccggtgctgaacgggctgctccgcaaggacccggccgagcggatcgacgccgaggtggccgagcggctcctgcggcgggccgccgggcgtcgcgccaagaccatctcgctgctcgacggcgtacgccggccggggccgaacggcccgcgcgagccgcgaccgccggtggtgcccgcaccgcgccccgccgaacagcgcaccggccggccggcggccccgcccgcaccgcgtaccccggaaggtggtcttgccgccggtggcgcggcggcggccggcgtgggcggcggcgacgcgaccgcgaaggtcccggcgggggtggacgccgcgccgaccgcgatggtcgacctgccgagcgccgacgccgatccgaccgcgaaggtcaccgacttcggcccgcaggcggccgatcccaccgcgaagatccccgcccccgacgccgcgaccagcgccgacgaggctgcgggcacgccggccggagggagtgacgggccgccggcggaccgggccgccgaggctggggacgaaggggccgacggggccccggcggccggtcgggccgacgacacccgagccgacgacacccgggtcgatccgggcgcggctgtgcccgtttcgccgcccgccccggcccgcgagcccgccgtcgcgccccgcgaggaggccgccccgacgtcggtgctgccggccgcctccggcccggcactctcgtcgacgggccgggccaccgtcgtcgggggcacgaagcccgagcgtcgccgccgcggcctgctggtcggcgcgctcgtcgcggtgctgctgatcggcctgctggcggcggtgccgctgctcggccggagcggtgacgacgacccggggcccggcggcgacccgcaggcgggcgtgtcgacgccgacgccgtcggccgcaccggcgaccagcagcgcggctccgcccagcccgacgccgtctgccagcccgtccgtggacccgaacgccctgcccgagggttggctcctgcacaaggacccggcgggcttctcgctgcccctgccgaagggctgggtgcggcgcagcgtggggcagaacacgatcgtcttcgacgagcgcgacggggtgggcgagctgctggtgcagtggaccagcaccccggagggcgacgcctacgccgactggaaagagaaggaaccggcccggaagaactacgtcaacggctaccagtatctgagcatcaagcgctgcgactactacaagacgtgcgcggactgggagtggttggagaaccgggacggcactcggatccacgtccgcaaccggggcttcgtcacggccagcaaccgggggtacgccctccggtgggaggtggcgaacaaggactggcaggcgcggctggccgacttcgaccggatcgccaagggcttcaagccggaccgggtcgac

SEQ ID NO: 79 - protein, 692 aa, Micromonospora carbonacea
  evsA
MGRVWKARDEVLHRDVAIKELVPPPSLTPEERREMRERSLREARAIARLNHVNVVRIFDVLRTDGDPWIVMEYVASKSLQDTLAEDGPVSPAKAVEIGLGVLGALKAAHKAGVMHRDIKPGNVLLGTDGRVVLTDFGLATIPGDPNVTRTGMVLGSPAYIAPERARDGTAGPEADLWSLGATLYAAVEGKSPFARPSAIATLAALATEPMPPPRNAGPLKPVLNGLLRKDPAERIDAEVAERLLRRAAGRRAKTISLLDGVRRPGPNGPREPRPPVVPAPRPAEQRTGRPAAPPAPRTPEGGLAAGGAAAAGVGGGDATAKVPAGVDAAPTAMVDLPSADADPTAKVTDFGPQAADPTAKIPAPDAATSADEAAGTPAGGSDGPPADRAAEAGDEGADGAPAAGRADDTRADDTRVDPGAAVPVSPPAPAREPAVAPREEAAPTSVLPAASGPALSSTGRATVVGGTKPERRRRGLLVGALVAVLLIGLLAAVPLLGRSGDDDPGPGGDPQAGVSTPTPSAAPATSSAAPPSPTPSASPSVDPNALPEGWLLHKDPAGFSLPLPKGWVRRSVGQNTIVFDERDGVGELLVQWTSTPEGDAYADWKEKEPARKNYVNGYQYLSIKRCDYYKTCADWEWLENRDGTRIHVRNRGFVTASNRGYALRWEVANKDWQARLADFDRIAKGFKPDRVD

SEQ ID NO: 80 - DNA, 1086 bp, Micromonospora carbonacea
  CDS (1)..(1086): evsB
gtgcgtgcgagtcctgaaaccgatggtgccttgcgaatacgggctgaccagtggcaccttaactacctgaaggcggcggaggctcagaagctgtcactgggagaaggggttgtagtagcggtcccggatactggcgttgatccacaccccgaccttcagcgcaatctaatcaaagggattgacatcattcccgggggcaatggagatggccagaaagatcgcaacagtcacggcactagcatggctggactaatcgcagcccacggacagggccagagcggcgccttaggcatagcacccagagccaagatcatgccaatcctgtcttccgcgtcgaacaacctcggtgatgcagacggcttggctgcgggtatagaatttgcaatctcgcatggggcggatgtcatcaatgtctccagcggaggcggcgccagcgttcgactcatcaaggcaatcagagaggcggtcgccgcagacattgtagttgtcgcagccgccggaaacagtcccgaagacatgacaattggctatccagccagcgaggaaggagtcgtcgcagttggcggaattgatcgacagggagagcatgcttcagtttctgtcgtcggaccggaagttgacttagtcgcaccggcagtcgacatctacagcaccagttacgacgggaagtactccaaaggcaccggtacgtccagtgccacagcgatagtcgcaggggccgctgctctggtccgatcgaagtttcccgacctgcccgcctcggaggtcgtccatcgcctcactgccaccgccatcgacaaagggccgccagggcacgacgaccagtacggctacggcgttatcgacctggttgccgcgcttacggcagacgtacccccggtgggctttgagtcggcgacggcggacgtgcccgacgtgcctgggtcgaccacgacggcggtcgccgagccggcaggcgagggtgacgatggggcaacggcccgaggtctggccacgttgggagtgatcgtggctgctgcgggcgcttgggcgctggtcgctcgacggcgtaggttgagcgacgacccgcccccgcggatcagccgg

SEQ ID NO: 81 - protein, 362 aa, Micromonospora carbonacea
  evsB
VRASPETDGALRIRADQWHLNYLKAAEAQKLSLGEGVVVAVPDTGVDPHPDLQRNLIKGIDIIPGGNGDGQKDRNSHGTSMAGLIAAHGQGQSGALGIAPRAKIMPILSSASNNLGDADGLAAGIEFAISHGADVINVSSGGGASVRLIKAIREAVAADIVVVAAAGNSPEDMTIGYPASEEGVVAVGGIDRQGEHASVSVVGPEVDLVAPAVDIYSTSYDGKYSKGTGTSSATAIVAGAAALVRSKFPDLPASEVVHRLTATAIDKGPPGHDDQYGYGVIDLVAALTADVPPVGFESATADVPDVPGSTTTAVAEPAGEGDDGATARGLATLGVIVAAAGAWALVARRRRLSDDPPPRISR

SEQ ID NO: 82 - DNA, 666 bp, Micromonospora carbonacea
  CDS (1)..(666): evsC
gtgccgaactcgatttcactccgactcgtgctcgcgtcggcgagccctgcccgtcgcaagctcctccacgccgccggcatcgaacccgacgtgctggtcagtggggtcgacgagtcccaggtgaccagcgagcgagccgaggatctgtgcctggagctggcccgcctgaaggcgcaggcggtcgtcggccggctgcgcccgtcggccgacgagcggacgctggtgctcggctgcgactcggtgctcgccttcgaccgcgagattctcggcaagccggccgacgaggcggacgctacccggcgttgggagcggatgcgggggcgcagcggggtgctacacaccgggcactgcctgatcgacgtcatccacgagacgcgcgccgaggcggtcgcctcgaccaccgtgcgtttcgctgacatcagcgacgaggagattgccgcgtacgtcgcgacgggcgaaccgctcgcggtcgccggcgcgttcaccatcgacggaatgggcggggcgttcctggagggtgtcgacggcgacccgggcacggtggtcggcctctccctaccgttgctgcgccggcttctcggcgagctggacctgcggatcatcgacctgtggacgaaggtcgcgccgggcggccaggcggtcgaggcggtgggtacggtccagcca

SEQ ID NO: 83 - protein, 222 aa, Micromonospora carbonacea
  evsC
VPNSISLRLVLASASPARRKLLHAAGIEPDVLVSGVDESQVTSERAEDLCLELARLKAQAVVGRLRPSADERTLVLGCDSVLAFDREILGKPADEADATRRWERMRGRSGVLHTGHCLIDVIHETRAEAVASTTVRFADISDEEIAAYVATGEPLAVAGAFTIDGMGGAFLEGVDGDPGTVVGLSLPLLRRLLGELDLRIIDLWTKVAPGGQAVEAVGTVQP

SEQ ID NO: 84 - DNA, 651 bp, Micromonospora carbonacea
  CDS (1)..(651): evbA
atgacgacgaagtccctgccgctgaccccggaactgcatgcgtacgtggtggcccacggatcggacccggacgaggtgatgcgggatctgatcgaggagaccctcgccgcgctgcccgccgaggcgaggatgcaggtggccccggagcaagccgcgttcctgacgttcctcacccggttgatcggggcgcggcgggcggtggaggtgggcaccttcaccggcctgtcctccctggcgatcgcgcgcgggctggccgagggcgggcggttgacctgcttcgacatctcggaggagtacacgggcgtcgcgcggcggtactgggcgcgggccggggtggccgaccagatcgacctgcggatcgggccggccggggacacgctgcgcgggttgccgtacgaacggcacctggacttcgcgttcatcgacgcggacaaggtcggctacccggtctactgggcggagttggtgccccgcatgctcccgggcggggtcatcgcggtggacaacacgttgcgcgggggccgggtgctcgccccgcgtgacgccgacgaccgggccatcgccgcgttcaacgacgaggtgatggccgacgtccgggtggagccggtgctgctgccgatcgccgacgggctgaccctggcccgggtgcgc

SEQ ID NO: 85 - protein, 217 aa, Micromonospora carbonacea
  evbA
MTTKSLPLTPELHAYVVAHGSDPDEVMRDLIEETLAALPAEARMQVAPEQAAFLTFLTRLIGARRAVEVGTFTGLSSLAIARGLAEGGRLTCFDISEEYTGVARRYWARAGVADQIDLRIGPAGDTLRGLPYERHLDFAFIDADKVGYPVYWAELVPRMLPGGVIAVDNTLRGGRVLAPRDADDRAIAAFNDEVMADVRVEPVLLPIADGLTLARVR

SEQ ID NO: 86 - DNA, 753 bp, Micromonospora carbonacea
  CDS (1)..(753): evbB
atgaagttcgcccgcgacacctggctcgtcgcccagcgccagatgcaactcctgctccgcaatccggtctgggtcttcgtcggcgtcttccagccggtgatgtacctgctcctcttcgccccgctgctcaagcccgcgctgaacgcgccgacccaggccgaggcgtacaagatcttcgtgcccggcctgctggtgctgctggccatcttcggcggcctcttccagggcttcggcctgatcgccgagctgcgcgccggcgtcatcgaacggtcccgggtcaccccggtcagccggctcgcgctgctgctcggccgggccctgcgcgacgtcgtgtcgctgctcgcccaggccgtcatcatcaccctgctcgcgctcctgttcgagctgcgcgtgttcatcggcgacctgctgctggcgtacctgatgctcgccctgatcgcgctgatgacctcggccgtctcgtacggcgtcgcgctcaaggtcaagagtgaggacgcgctcgccccggtgatgaacaccgtcgcccagccggtgctgctgctctccggcatcctgctgccgctcaccttcgcccccggctggctccagcgcatcgccgagtggaacccgttctcctgggccgtggacggcacccgggccctcttcgccggcgacctcggcaacgacaaggtctggcagggcctgaccatcatcgcggtgcttgccgccgtcggcgtcgcctgggccgcccgccagttcgcccgcagcgtgcgc

SEQ ID NO: 87 - protein, 251 aa, Micromonospora carbonacea
  evbB
MKFARDTWLVAQRQMQLLLRNPVWVFVGVFQPVMYLLLFAPLLKPALNAPTQAEAYKIFVPGLLVLLAIFGGLFQGFGLIAELRAGVIERSRVTPVSRLALLLGRALRDVVSLLAQAVIITLLALLFELRVFIGDLLLAYLMLALIALMTSAVSYGVALKVKSEDALAPVMNTVAQPVLLLSGILLPLTFAPGWLQRIAEWNPFSWAVDGTRALFAGDLGNDKVWQGLTIIAVLAAVGVAWAARQFARSVR

SEQ ID NO: 88 - DNA, 957 bp, Micromonospora carbonacea
  CDS (1)..(957): evbC
atgatccagaccagagggctgcggaagtcgtttcgctcccgcgccggtcgacagcacaagacggtcgacgccgtgcgcggcgtcgacctggacgtcgccgagggggagatcttcgggttcctcggccccaacggcgccgggaagaccaccaccctgcggatgctggccaccctcatcacccccgacggcggccaggccaccatcgccggggccgacctgctgcggaacccggccgaggtgcgtcgccggatcggctatgtcgcccagggcggcagcacctgggacgactccaccgcccgcgaggaactggtcctgcacgcccggatgtacggcatcggcaaggccgacgccctccgccgcgccgagcgcgcactggccgccttccagctcaccgagtacgccgaccgtaagtgcaagacctactccggcggccagcgccgccgcgtcgagatcgctctcggcatcatccacgacccccgcattgtcttcctggacgagccgaccagcggcctcgacccgcagagtcgcgcccacatgtgggacgagatccgtcggctgcgcgccgaggggatgaccgtcttcatcaccacgcactacctggacgaggccgacgcgctctgcgaccggatcgcgatcatggaccacggcgaggtggtcgccgagggtacgccgggcgggctgaagcgggagatctccggcgaggtgctgctcgtcgggctggacgccgccgccaccccgcaggccgcccaactgctcgacaccgagccgtacgtcaccaagctggaaaccgtcgacggcggcggcctgcgcctgaccgtcgacgagggggccaccgccatcccgcaggtcctgcgccggctcgaccagtccggcctcaggctcagctcgatcgagctgcaccgccccagcctcgacgacgtcttcctcaccaagaccggccgctcgctgcgcgagtcc

SEQ ID NO: 89 - protein, 319 aa, Micromonospora carbonacea
  evbC
MIQTRGLRKSFRSRAGRQHKTVDAVRGVDLDVAEGEIFGFLGPNGAGKTTTLRMLATLITPDGGQATIAGADLLRNPAEVRRRIGYVAQGGSTWDDSTAREELVLHARMYGIGKADALRRAERALAAFQLTEYADRKCKTYSGGQRRRVEIALGIIHDPRIVFLDEPTSGLDPQSRAHMWDEIRRLRAEGMTVFITTHYLDEADALCDRIAIMDHGEVVAEGTPGGLKREISGEVLLVGLDAAATPQAAQLLDTEPYVTKLETVDGGGLRLTVDEGATAIPQVLRRLDQSGLRLSSIELHRPSLDDVFLTKTGRSLRES

SEQ ID NO: 90 - DNA, 594 bp, Micromonospora carbonacea
  CDS (1)..(594): evbC2
atgatgattctcggcctggtcaagtggatgcagccggtgcacggctacgacgtccgccgcgagctgctcagttggggtgccgacaagtgggccaacgtgcagcccggctcgatctaccacgcgctgcgcaagctcggcgaggaggggctgctccgcgaggtcgccaccgagcaggtcggcgcccggcgggcgcggacgacgtacgagatcaccccgaagggggtcgacgagttcgagacgctgctgcgcggcctgtggtggggcaatcatcagacgagcgatccgttcgtggcggcgttcgcgttcctgccggcgctgcccaggccggaggcggtggccgcgctgcgcagtcgggggcaggtgctgcgggccagtgtcgaaaccatgcgtgcctcgatggagtcctcctggatccgcgactccaagccggtcggcgtgagctggatgtacgagctgtggattgcccggggagaggtcgaggtggcctggtgtgagcgggtcgccgaccggatcgaggccggcgtgccgtatctgcccgaagggttggccagtcaggacggctggaacgtgggggagggggccgacggtcgccat

SEQ ID NO: 91 - protein, 198 aa, Micromonospora carbonacea
  evbC2
MMILGLVKWMQPVHGYDVRRELLSWGADKWANVQPGSIYHALRKLGEEGLLREVATEQVGARRARTTYEITPKGVDEFETLLRGLWWGNHQTSDPFVAAFAFLPALPRPEAVAALRSRGQVLRASVETMRASMESSWIRDSKPVGVSWMYELWIARGEVEVAWCERVADRIEAGVPYLPEGLASQDGWNVGEGADGRH

SEQ ID NO: 92 - DNA, 1746 bp, Micromonospora carbonacea
  CDS (1)..(1746): evbD
gtgcgcaaggtactcatcgccaaccgaggcgagatcgccgtccgcgtcatccgcgcctgccgcgacgccggcctgggcagcgtcgccgtctacgcggactccgaccgggacgccctgcacgcgaccctggccgacgaggcgtacgccctgggcggcgacaccgccgccgagacgtacctgcggatcgacaagctgatcgccgtcgcggcacaggccggggccgacgccgtccaccccgggtacggcttcctcgccgagaacgccgacttcgcccaggccgtcctcgacgccgggcttacctggatcggcccgaccccacaggcgatccgcgacctgggcgacaaggtcaccgcccggcacatcgcccagcgggccggcgcgcccctggttcccggtacctcggacccggtcggcagcccggacgaggtgatcgcattcgcggtcgaccacggcctgccggtcgccatcaaggccgccttcggcggcggcgggcgcggcctcaaggtggcccgcacgatggaggagatcccgcacctgttcgagtcggccacccgggaggcggtcgcggcgttcggccggggcgagtgtttcgtcgagcggtacctcgaccagccccggcacgtcgaggcccaggtcctcgccgaccagcacggcaacgtgatcgtcgtcggcacccgggactgctcgctgcaacgccggcaccagaaactcgtcgaggaggcccccgcgccgttcctcaccgacgcccagcgccggcagatccacgacagcgccaaggcaatctgccgggaggccggctaccacggcgccggcaccgtggagtacctggtgggcacggacggcacgatctccttccttgaggtcaacacccgcctgcaggtcgagcacccggtcaccgaggaaaccgccggcatcgacctcgtccgcgagcagttccggatcgccgacggcgagaagctgcggctggccgaggatccgaccccgcgcgggcactccatcgagttccggatcaacggcgaggatccgggccgcaacttcctgcccgcccccggcaccgtcaccgcgctgcggctgcccaccggccccggtgtccgggtggacaccggcatctccgccggcgacgtgatcggcggcaacttcgactccctgctggccaaggtgatcatcacgggcgagacccgcaccgaggccctggagcgggcccggcgggcgctggacgagatggtcgtcgagggaatggccacggcgctgccgttccaccgcctggtggtacgcgaccccgcgttcaccgccgcgccgttcaccgtgcacacccggtggatcgagacggagttcgacaacaccgtcctgccgttcaccgccgccgccggccccgccgagggcccggccgagcgggagaccgtcgtggtcgaggtgggcggcaagcggctggaggtgaccctccccgccggcctcggcgcgggtacggccgccgggcccgccgcgcggaagccggcccggcggggcggcggggccaaggccggcgcggcggtcggcggcgacgccctcacctctccgatgcagggcacgatcgtgaagatcgccgtcgcggacggggacaccgtcgccaagggcgacctggtcgtcgtgctggaggcgatgaagatggagcagccgctgcacgcgcacaaggcgggcacggtcggcgggctgtccgccgaggtcggcgcggtcctcgccgccggcgcccccatctgcaccatcacc

SEQ ID NO: 93 - protein, 582 aa, Micromonospora carbonacea
  evbD
VRKVLIANRGEIAVRVIRACRDAGLGSVAVYADSDRDALHATLADEAYALGGDTAAETYLRIDKLIAVAAQAGADAVHPGYGFLAENADFAQAVLDAGLTWIGPTPQAIRDLGDKVTARHIAQRAGAPLVPGTSDPVGSPDEVIAFAVDHGLPVAIKAAFGGGGRGLKVARTMEEIPHLFESATREAVAAFGRGECFVERYLDQPRHVEAQVLADQHGNVIVVGTRDCSLQRRHQKLVEEAPAPFLTDAQRRQIHDSAKAICREAGYHGAGTVEYLVGTDGTISFLEVNTRLQVEHPVTEETAGIDLVREQFRIADGEKLRLAEDPTPRGHSIEFRINGEDPGRNFLPAPGTVTALRLPTGPGVRVDTGISAGDVIGGNFDSLLAKVIITGETRTEALERARRALDEMVVEGMATALPFHRLVVRDPAFTAAPFTVHTRWIETEFDNTVLPFTAAAGPAEGPAERETVVVEVGGKRLEVTLPAGLGAGTAAGPAARKPARRGGGAKAGAAVGGDALTSPMQGTIVKIAVADGDTVAKGDLVVVLEAMKMEQPLHAHKAGTVGGLSAEVGAVLAAGAPICTIT

SEQ ID NO: 94 - DNA, 1437 bp, Micromonospora carbonacea
  CDS (1)..(1437): evbE
gtgcggttcctacatggcgcggttcccgcgcacgacctgacctacaacgacgtcttcatggcgccgaaccgctccgaggtcggctcccggttggacgtcgacctggccacctccgacggcacgggcaccaccatcccgctggtggtggcgaacatgacggcggtggccggccggcggatggccgagactgtcgcccggcggggcgcactcgcggtgatcccgcaggacatcccgatcgaggtggtggccaacgtggtcgcctgggtcaagcaacggcacctggtgcacgacacggcgatcacgctcggccccaccgacaccgtcggcgatgccatccatctgctgccgaaacggtcgcatggcgcggtggtggtggtcgacgaggccggtcggccgctgggcgtggtgacggaggcggacaccgtcggggtggaccgcttcgcccagctccgccacgtgatgtcgaccgagttgcacacggtgccggcggacgcggacccgcgtaccggattcgaccggctctcggcgggccggcggcggctcgcgccggtggtggacggcgacggccggctcgtcggggtgttgacccgcaagggcgcgctgcgcgcgaccctctacaccccggcggtggacgaccggggccggctgcggatcgcggcggccgtcggcatcaacggcgacgtcaccggcaaggccgccgcgctgctggaggccggggtcgacgccctggtggtggacaccgcgcacggccaccaggcgcggatggtcgccgcgctgcgggcggtgcgcaagcttcacccgggcgttccggtcgcggccggcaacgtggtcaccgccgatggggtacgcgacctcgtcgaggccggcgccgacatcgtgaaggtgggcgtcggtccgggcgcgatgtgcaccacccggatgatgaccggggtggggcgtccgcagttctccgcggtgctggactgcgcggcggcggcgcgggacctcggccggcacgtctgggccgacggcggggtacggcacccgcgcgacgtggcgctggccctcgccgccggcgcgtcgaacgtgatgatcggttcctggttcgccggcacgtacgagtccccgggtgacctgtacacggacgcggacggccggaggtacaaggagagcttcgggatggcctcgtcgcgggcggtcagcgcgcgtacggccgaggacagcgcgttcgaccgggcccgcaaggggatcttcgaggagggcatctcctcggcccggatgtacctcgacccggatcgcccgggcgtcgaggacctgatcgacgagatcatctccggggtacgcagcgcgtgcacgtacgcgggcgcgcgcagcctggcggagttcgcggagcgggcgctggtcggggtgcagagcacggccggctacaccgaggggatgcccctaccgacgagttgg

SEQ ID NO: 95 - protein, 479 aa, Micromonospora carbonacea
  evbE
VRFLHGAVPAHDLTYNDVFMAPNRSEVGSRLDVDLATSDGTGTTIPLVVANMTAVAGRRMAETVARRGALAVIPQDIPIEVVANVVAWVKQRHLVHDTAITLGPTDTVGDAIHLLPKRSHGAVVVVDEAGRPLGVVTEADTVGVDRFAQLRHVMSTELHTVPADADPRTGFDRLSAGRRRLAPVVDGDGRLVGVLTRKGALRATLYTPAVDDRGRLRIAAAVGINGDVTGKAAALLEAGVDALVVDTAHGHQARMVAALRAVRKLHPGVPVAAGNVVTADGVRDLVEAGADIVKVGVGPGAMCTTRMMTGVGRPQFSAVLDCAAAARDLGRHVWADGGVRHPRDVALALAAGASNVMIGSWFAGTYESPGDLYTDADGRRYKESFGMASSRAVSARTAEDSAFDRARKGIFEEGISSARMYLDPDRPGVEDLIDEIISGVRSACTYAGARSLAEFAERALVGVQSTAGYTEGMPLPTSW

SEQ ID NO: 96 - DNA, 555 bp, Micromonospora carbonacea
  CDS (1)..(555): evbF
atgaccggaccgcgtggctaccatcacggtgacctgcgtcgcgccctgctcgccgccgccgtcgacgcgatcaccgacgccgggccggccgccctgagcctgcgcgacctggcccgccgggccggggtctcgcacgccgcccccgcgcaccacttcggcgacaaggcggggctgctcaccgcgctcgccgtcgagggattcgacctgctggccggggcgctgtgcgaggccggcgacctgctcgacgccggcgtggcgtacgtccggttcgcggtcgaccaccgggcccacttcgaggtgatgttccgcccggagctctaccgtcgcgacgaccccgaggtgacagccgcccgtgatcgggccggcgcggcgctgcgggccggggtggccgccctcccgcgccgggaaaccgacccggaccaggaggcggacgccctggccgcctggtcgatcgtgcacggcttcgtgacactctggctggccggggcgctcccgcccggcaccggcccggacccggaggccgccgcccggaccgtcatccgtcgcctcttcgac

SEQ ID NO: 97 - protein, 185 aa, Micromonospora carbonacea
  evbF
MTGPRGYHHGDLRRALLAAAVDAITDAGPAALSLRDLARRAGVSHAAPAHHFGDKAGLLTALAVEGFDLLAGALCEAGDLLDAGVAYVRFAVDHRAHFEVMFRPELYRRDDPEVTAARDRAGAALRAGVAALPRRETDPDQEADALAAWSIVHGFVTLWLAGALPPGTGPDPEAAARTVIRRLFD

SEQ ID NO: 98 - DNA, 270 bp, Micromonospora carbonacea
  CDS (1)..(270): evbF1
atggtgccgccccgactgccccacccggggctgctggtgaccgtcaccggcctgctggagttggccggcgcggtcgcgctgctcgtccccggcacggcgcggtgggcagcggccgggctggggctgctgctgctcgcgatgttcccggccaacgcctcggccgcccggcgcgggctgaccctggccggccggccggtgaccccgctcgtcccccgcgcgctgctccaggtgatcttcctcaccgccgccgccgcgatttcgtttgggccc

SEQ ID NO: 99 - protein, 90 aa, Micromonospora carbonacea
  evbF1
MVPPRLPHPGLLVTVTGLLELAGAVALLVPGTARWAAAGLGLLLLAMFPANASAARRGLTLAGRPVTPLVPRALLQVIFLTAAAAISFGP

SEQ ID NO: 100 - DNA, 456 bp, Micromonospora carbonacea
  CDS (1)..(456): evbF2
gtgccactcggccggctgctggtgaccgccggccacgtcgtcggccaacggtggaaccgctacctcgccgaggagcacggcctcacccaggcgggcatggtcaccctgatgaccctggcccggcacggcgagctgccgcaccgggcggtcgccgaggcgtgcttcatccgcccggccaccctaaccggcatcgtcgacacactggagcgcgacggcctcgtcgagcggcaacgcgacgacgtcgaccggcgcagcgtgcggctcgtcctgacccccgccggtcgggaacgggtcgccgcgctcaccaacgtcatgcagtccggacgaccgatgacctcggtcgacgccgacccggcgaaggccgccgtgatccggcagttcctgctcgaggtcatcggcagtggagaggaacctcgggtgacggccctcgacgcgaggccggaggctccggcatgc

SEQ ID NO: 101 - protein, 152 aa, Micromonospora carbonacea
  evbF2
VPLGRLLVTAGHVVGQRWNRYLAEEHGLTQAGMVTLMTLARHGELPHRAVAEACFIRPATLTGIVDTLERDGLVERQRDDVDRRSVRLVLTPAGRERVAALTNVMQSGRPMTSVDADPAKAAVIRQFLLEVIGSGEEPRVTALDARPEAPAC

SEQ ID NO: 102 - DNA, 1671 bp, Micromonospora carbonacea
  CDS (1)..(1671): evbG
atggcgttgcagttcgtcggcacgatggcctcgctctacctgccgagcctcaacgccgacatcatcgaccagggtgtggcccggggcgacaccggctacatcatgcgtacgggcggctggatgctgctggtcagcctggtgcagatcgcctgctccaccgccgcggtcttcctcggcgcgcgctccgcgatgggcttcggccgggacgtacgcgccgaggtcttcgcccacgtcaaccggttctccgcccgcgaggtgacccgcttcggcgcaccctcgctgatcacccgcaacaccaacgacgtgcaacaggtgcagatgctcgtcctgatgagctgcaccatgctggtcgccgcgccgatcatgagcgtcggcggggtgttcatggcactgcgggaggacgtcgggctgtcctggctgatgctggtcagcgtgccggcgctggcgatcgccctgatgctgatcatccggcggatggtgcccgggttccggctgatgcagacccgcatcgacgcggtcaaccgcgtgctgcgcgagcagatcaccggcatccgggtggtccgggcgttcgtccgcgagccgtacgagacggcgcgcttcggccgcgcgaacgccgacctcaccgcgaccgccctgcgcaccggtcggttgatggccctgatcttccccgtggtgacgctggtgctcaacgtctccagcgtcgccgtgctgtggttcggcgcggaccgcgtcgacgccggccagatccaggtcggcgcgctcaccgccttcctgcagtacctcatgcagatcctgatggccgtcatgttggccaccttcatcctgatgatggtcccgcgcgccgcggtctgcgccgagcggatcgtcgaggtgctcgacaccgactcgacggtgatcccgccggccgcgccgacggccgaggtgaccggccggggcgaactggaactgcgcggcgtccggttccagtacccgggggcgagcgcgccggtgctgcacgacatctcgttccgggccacgcccgggcgcaccacggccatcatcggcagcacgggggccggcaagacgaccctgctgacgctgatcccccggctgatcgacgccaccgccggggcggtgctggtcgacggggtggacgtgcgtgacctggccccggacgatttgtggcggcggatcgggctggtgccgcagcggccgtacctgttcagcggcacgatcgccagcaacctgcggtacggcaacccggacgccaccgacgcggagctgtgggccgccctggagatcgcccaggcgcgcgacttcgtcgccgagttgcccgaagggctgaacgccccgatcacgcagggcggcaccaatatctccggcgggcagcgccagcgcctcgcgatcgcccgggccctggtccgcaagccggagatctacctgttcgacgactcgttctcggcgctcgacctgggcaccgacgcccggctgcgcgcggcgctacgaccggtcaccgcggacgcgacggtgctgatcgtggcccagcgggtctccacgatcgtcgacgccgaccagatcatcgtgcttgaggacgggggcatcgtcgggatgggccgacacgccgaactactggaagactgcccgacgtacgcggagatcgtcgcctcccagcagacggcgggggtgccggca

SEQ ID NO: 103 - protein, 557 aa, Micromonospora carbonacea
  evbG
MALQFVGTMASLYLPSLNADIIDQGVARGDTGYIMRTGGWMLLVSLVQIACSTAAVFLGARSAMGFGRDVRAEVFAHVNRFSAREVTRFGAPSLITRNTNDVQQVQMLVLMSCTMLVAAPIMSVGGVFMALREDVGLSWLMLVSVPALAIALMLIIRRMVPGFRLMQTRIDAVNRVLREQITGIRVVRAFVREPYETARFGRANADLTATALRTGRLMALIFPVVTLVLNVSSVAVLWFGADRVDAGQIQVGALTAFLQYLMQILMAVMLATFILMMVPRAAVCAERIVEVLDTDSTVIPPAAPTAEVTGRGELELRGVRFQYPGASAPVLHDISFRATPGRTTAIIGSTGAGKTTLLTLIPRLIDATAGAVLVDGVDVRDLAPDDLWRRIGLVPQRPYLFSGTIASNLRYGNPDATDAELWAALEIAQARDFVAELPEGLNAPITQGGTNISGGQRQRLAIARALVRKPEIYLFDDSFSALDLGTDARLRAALRPVTADATVLIVAQRVSTIVDADQIIVLEDGGIVGMGRHAELLEDCPTYAEIVASQQTAGVPA

SEQ ID NO: 104 - DNA, 1935 bp, Micromonospora carbonacea
  CDS (1)..(1935): evbH
atgagcgccggcatgccggccgagaagtcgatgaacttcgggccgtccacccgccggctgctgcgccggctgcgaccgcaccgcctccagctggccgccatcgtcctgctctcgctggtcagcgtcggttgcaacgtgtacgggccgaaggtgctcggccacgccaccgacctgatcttcagcggggtgatcggccggcagttgccggccggcaccaccgccgagcaggcggtcgcggcggcccgcgcggccggtaacgacagcttcgccgacatgctggcccggatggacgtggtgcccggggtgggcatcgacttcaccgccctgggccgggtgctgctgttcgtgctcgccctctacctggcggccagcgtgctgttgtggtggcagggctggctgctcaacggggtggtgcagcgcacggtgctgcggctgcgcgccgacgtggaggacaagctgaaccggctgccgctgccgtacttcgaccggcagccccggggcgagttgctcagccgggtcaccaacgacatcgacaacatctcgcagagcctccagcagacgctgagccagctgctcacctcgctgctcaccgtggtcggcgtactggccatgatgttctggatctcgccgctgttggcgctggtgtccctggtcgcggtgccgatgtcggtggtggtcaccagcctggtcgcgaagcggtcacagcagcggttcatcgcccagtggacgcataccggagagctgaacggccagatcgaggaggcgttcaccggacacgagctggtcaaggtcttcggccggcagcgcgaggtggaggccgccttcaccgccaagaacgaggagctgttccgggccagcttcggcgcccagttcatctccgggatcatcatgccggcgatgatgttcatcgggaacctcagctacgtcgcgatcgccgtggtcggcgggctgcgggtggcgtcggggtcgatgagcatcggcgacgtgcaggcattcatccagtactccctccagttcacccagccgctgacccgggtcgcctcgatggccaacctgctccagtccggggtggcctccgccgagcgggtgttcgcggtgctcgacgccgaggagcagagcccggacccggcggtgccggcccgggtcgccgaccagcgcggtcgcgtcgaattcgaccacgtctcattccggtacgagccggacaagccgctgatcaccgacctgtcgctggtcgccgagccggggcacacggttgccatcgtcgggccgaccggcgccggcaagaccaccctggtcaacctggtgatgcgcttctacgagctggacgccggccggatcaccctcgacggggtcgacatcaccacgctgagccgcgacgacctgcgcggccggatcggcatggtgctccaggacacctggctcttcggtggcacgatccgcgacaacatcgcgtacggccggccggacgcgagcgaggaggagatcgtcgccgccgcccgggcgacgttcgtggaccggttcgtgcgtagcctccccgacggctacgacaccgtcatcgactccgagggcagcaacgtcagcgccggcgagaagcagctcatcaccatcgcccgggcgttcctggccgagccgtcgctgctgatcctcgacgaggcgaccagttcggtggacacccgcacggaggtgctgctccaacgggccatggcggcgctgcgctcggaccggaccagcttcgtcatcgcccaccgtttgtccaccatccgcgacgcggacctgatcctgatgatggagcacggtcgcatcgtcgagcagggcacccacgagcagctcctggccgcccggggcgcgtaccaccggctttaccaggcccagttcacccagccggacccggccgccgtcggggaccccgagccccagcccgcctcggtccggggc

SEQ ID NO: 105 - protein, 645 aa, Micromonospora carbonacea
  evbH
MSAGMPAEKSMNFGPSTRRLLRRLRPHRLQLAAIVLLSLVSVGCNVYGPKVLGHATDLIFSGVIGRQLPAGTTAEQAVAAARAAGNDSFADMLARMDVVPGVGIDFTALGRVLLFVLALYLAASVLLWWQGWLLNGVVQRTVLRLRADVEDKLNRLPLPYFDRQPRGELLSRVTNDIDNISQSLQQTLSQLLTSLLTVVGVLAMMFWISPLLALVSLVAVPMSVVVTSLVAKRSQQRFIAQWTHTGELNGQIEEAFTGHELVKVFGRQREVEAAFTAKNEELFRASFGAQFISGIIMPAMMFIGNLSYVAIAVVGGLRVASGSMSIGDVQAFIQYSLQFTQPLTRVASMANLLQSGVASAERVFAVLDAEEQSPDPAVPARVADQRGRVEFDHVSFRYEPDKPLITDLSLVAEPGHTVAIVGPTGAGKTTLVNLVMRFYELDAGRITLDGVDITTLSRDDLRGRIGMVLQDTWLFGGTIRDNIAYGRPDASEEEIVAAARATFVDRFVRSLPDGYDTVIDSEGSNVSAGEKQLITIARAFLAEPSLLILDEATSSVDTRTEVLLQRAMAALRSDRTSFVIAHRLSTIRDADLILMMEHGRIVEQGTHEQLLAARGAYHRLYQAQFTQPDPAAVGDPEPQPASVRG

SEQ ID NO: 106 - DNA, 1401 bp, Micromonospora carbonacea
  CDS (1)..(1401): evbI
gtgagccagatcgtgatcatcggcggggggccggccgggtacgaggcggccctggtcgccgcccagttggacgctgatgtcaccgtggtggaggccgagggggccggcggtgcctgcgtgctgtccgactgcgtaccgtcgaaaacgttcatcgccagctcggaggtggtcaccgggtaccgggacaccgaggagttcggggtgcactccgacgggctggaggcggtcaccgtcgacgcccgggccgtgcacgagcgggtcaagcggctcgccctggcccagtccgccgacatccacgcgaagctggtgaaagccggcgtcaccttcgtggccggcacggcccggctcggcgaggacatgctgggccacacccaccgcgtcgtcgtcacgccggccgacggctccgagaagcactcgatcgacgcgtcgaccgtgctggtcgccaccggcgccaccccccgccagctccccacggccgtgccggacggcgagcgcatcctgacctggcggcaggtgtacgacctgccgcacctgcccgagcacctgatcgtcgtcggttccggcgtcaccggtgccgagttcgccagcgcgtacctggccatgggggtcccggtcaccctcgtctccagccgggaccgggtgatgccgcacgaggacgccgacgccgccatggcgatcgagcgcgtgttccgctcccggggcatgacgatcctcaacaactcccgcgccgagagggtccagcgcatcgccgacggggtggaggtcgaactggccgacggccggctggtgcacggctcgcacgcgctcatcgcggtcggctcgatccccaacaccgccaacctcggcctcgccgagtacggcgtcgagctggcccggggcggctacgtcaccgtcgaccgggtgtcccgcaccaacgtccccgggatctacgctgccggcgactgcaccggggtgttgccgctggccagcgtcgccgccatgcagggccggatcgcgatgtggcacgcgctcggcgaggcggtccggccgctgcggctgcgtacggtggccgcgaacgtcttcaccgacccggagttggccaccgtcggcgtctcccaggacgaggtggacgccggcaagaccccggcccgccaggtgatgctgccgctgtcgggcaacgcccgggcgaagatggacgacctcgccgacggcttcgtgaagctgttctgccgcccggccagcggccaggtgatcggcggtgtggtggtggcaccgaaggccagcgagctgatcctgccgatcaccatggcggtggagaacaacctcacggtcaacgagttggcccagaccatcaccatctacccgagcctgtcgggctcgatcaccgaggccgcccgccagctcatgctccacgagctggag

SEQ ID NO: 107 - protein, 467 aa, Micromonospora carbonacea
  evbI
VSQIVIIGGGPAGYEAALVAAQLDADVTVVEAEGAGGACVLSDCVPSKTFIASSEVVTGYRDTEEFGVHSDGLEAVTVDARAVHERVKRLALAQSADIHAKLVKAGVTFVAGTARLGEDMLGHTHRVVVTPADGSEKHSIDASTVLVATGATPRQLPTAVPDGERILTWRQVYDLPHLPEHLIVVGSGVTGAEFASAYLAMGVPVTLVSSRDRVMPHEDADAAMAIERVFRSRGMTILNNSRAERVQRIADGVEVELADGRLVHGSHALIAVGSIPNTANLGLAEYGVELARGGYVTVDRVSRTNVPGIYAAGDCTGVLPLASVAAMQGRIAMWHALGEAVRPLRLRTVAANVFTDPELATVGVSQDEVDAGKTPARQVMLPLSGNARAKMDDLADGFVKLFCRPASGQVIGGVVVAPKASELILPITMAVENNLTVNELAQTITIYPSLSGSITEAARQLMLHELE

SEQ ID NO: 108 - DNA, 453 bp, Micromonospora carbonacea
  CDS (1)..(453): evbJ
gtgcgtcactacgccgcctacggctcaaacctggaccccgcccggatgcgcgcctactgcccgcactccccgatggtcggcgtcggctggctggagggctggcggctcaccttcgcgggtgagggcgcgatcggctgggagggcgcggtcagcaccatcgtcgagtcccccggtgatcgggtgttcgtggcgctctacgacatccacccgtacgacgccgtccagctcgacgagatcgagggggtggcctccgggacgtaccgcaagctgcacgtccgcgtctccaccctcgacggcgacgtgaccgcgtgggtctacgtcttcgacgggtacgagggcggcctgccgacggcgtggtatctgtcggagatcgccaacgccgccgagaaggcgggcgcgcccgacgactacgtcagcgagctgcggtcccgccccaccggcacggcgtcggcg

SEQ ID NO: 109 - protein, 151 aa, Micromonospora carbonacea
  evbJ
VRHYAAYGSNLDPARMRAYCPHSPMVGVGWLEGWRLTFAGEGAIGWEGAVSTIVESPGDRVFVALYDIHPYDAVQLDEIEGVASGTYRKLHVRVSTLDGDVTAWVYVFDGYEGGLPTAWYLSEIANAAEKAGAPDDYVSELRSRPTGTASA

SEQ ID NO: 110 - DNA, 963 bp, Micromonospora carbonacea
  CDS (1)..(963): evbK
gtgactcttcccgctgactgggcggcgcgccgccccaccctcgacgacgtccctgggatcctcgccgtcgtgcacgccgcagacaccttcgcgatcggccacccggacttcgacgccgaagacgtcaaggccgccctgacggcccccttcttcgacccggcgcgcgactcctggctggtcagcgacccgcagggccggctcgtcgcctggtcggtggtggacaacccgaccggggtgggccgggagttcgtcgacgtcctcgtcgacccggagcgcgccgaggcggtacgcgccccgctgctcgctctgatgctggaccgggtcgccgagcgggccgcggagcggagcctgcccgcgctgaccgtccgcgcctcggcctacccgccggagacccgctgggtgacggagctgaccgaggccggtttcagccgggtgaagcggtacgtacggatgagtcgtgacctggccgggctgcccgccgagccgccgcccccacccggggtgacggtccggccgctgcgcgccggcgacgaggacgacctgcgcctgttccaccggatctacgacacggcgttccgggacaccccggactacgagccggccgggtacgaccactggcgggagcgtctgcccgcgtacgacaggacctgggacgagtggttcgtcgccgaggtcgacggggagccggccggcgcgttgcagtcgtccgaccaggcgctggaacaggactcgggctgggtgcggaccctgtcggtgctgccgaagtaccggcggcacggggtcggcgccgcgctgctgtggcgggccttcacggtctacgcggcgaagggacggcggcacgccggcctcggcgtcgacctgaccaacccgacctccccggcgacgctctaccgctcggtggggctgcgcgagatgcgctggaccgacatgtacgagcgcaccgtccccgccgccacggcggtg

SEQ ID NO: 111 - protein, 321 aa, Micromonospora carbonacea
  evbK
VTLPADWAARRPTLDDVPGILAVVHAADTFAIGHPDFDAEDVKAALTAPFFDPARDSWLVSDPQGRLVAWSVVDNPTGVGREFVDVLVDPERAEAVRAPLLALMLDRVAERAAERSLPALTVRASAYPPETRWVTELTEAGFSRVKRYVRMSRDLAGLPAEPPPPPGVTVRPLRAGDEDDLRLFHRIYDTAFRDTPDYEPAGYDHWRERLPAYDRTWDEWFVAEVDGEPAGALQSSDQALEQDSGWVRTLSVLPKYRRHGVGAALLWRAFTVYAAKGRRHAGLGVDLTNPTSPATLYRSVGLREMRWTDMYERTVPAATAV

SEQ ID NO: 112 - DNA, 747 bp, Micromonospora carbonacea
  CDS (1)..(747): evbL
atgacgccggagcaggtcgccgccgcgagcaagccgttggtgctggagctcggggagatgttcgcccgctgcccggccaccctgcaccgggcccgtctgctgggcatctccggctgggccttccacatcgccggccgggccggggtgctcggcgacgtcggggccgccacggtgagcgcggccctcggcttcgtcgcccccgacgcggtcgccgacgggtgggacgccgccgcccgcgtgcacgctccgctggaggtggccacggcgaacctggccgagtgctgccggtggggcagcgagcacctgaccgccgtgcccggcgtgatccgtctggcgacgctgctgcaccgggtggtcgacgccgcggacgccagcgggatgccactctttgccgcctggcgggccgtgccgccgccggacgacaccccgggggcccgtgccgccgccgggctgctgctgcttcgggagcacttcgccggggcgtacctgctggcggtgcgggccggcgggatgacgccgctggaggcggtgctggccgggccggagggggaggccggggcgctggcctgcggctggccgccgccgtacccccgggtcgggccgctggtgcgccgccggctgtggtcggaggcggtgaccgaccggctggtgtcgaccggattccgggcgctcacgccggccgagggcaccgcgctgctcgacctgctgaccaccgcacgcgccgtggtgcaaggaagggccccttac

SEQ ID NO: 113 - protein, 249 aa, Micromonospora carbonacea
  evbL
MTPEQVAAASKPLVLELGEMFARCPATLHRARLLGISGWAFHIAGRAGVLGDVGAATVSAALGFVAPDAVADGWDAAARVHAPLEVATANLAECCRWGSEHLTAVPGVIRLATLLHRVVDAADASGMPLFAAWRAVPPPDDTPGARAAAGLLLLREHFAGAYLLAVRAGGMTPLEAVLAGPEGEAGALACGWPPPYPRVGPLVRRRLWSEAVTDRLVSTGFRALTPAEGTALLDLLTTARAVVQGRAPY

SEQ ID NO: 114 - DNA, 918 bp, Micromonospora carbonacea
  CDS (1)..(918): evbM
gtgccgcccccgcagagcctcctccggcggctctacaccgagccgccggagaagttcgtcgccacccgcgacgccgccgtcgccgaggcccggcgctccggcgacccggccacggcccgcgagatcgcccggctgcgccgcccgaccgtggccgcgtggctggtcaacctgctcgccctgcgccgccccgagctggtcgccgacctgacccaactcgccgaggcgctgcgccgcgcccagcgcgacctgcgcggcccccggctgcgggaactctccgcccagcggcgggcggcggtcgccgcgctggtcgccgaggcgcgccggctggccgccgacgccgagggcggcccgccggccgggaagctgccgctgggcgaggtggaggcgacgctcgacgccgcgctctccgacacggaggtggccgggcaggtgcgctccggccggctgctgcgggccgccagctacgccggcttcggcgaggtgccccgcccccagctccgtttggtcaccggcggcgaggagcagccaccgcccacccacccaccaccgcgcgcgaagcgggccgcccgggaggccgagcgcgccgcccgtgccgagcgggcccggcaacgccggatgctggaacgggaactggcgcgggcgcgtaccgaccaggagcgggccgaggcggagctggccggcgcggtggaggccgagcacgacggtgccgaggaactgaccggcatcgagcggtcgctggccgagctggagcgatcgcgcgcagaggccgagcaggaactcagccggcggaagctggcccggcgggcggcggaacgggccgtcaccgccgcccagcgccgcaccggcgaaatcgagggggcgatcgaggcggtcgacgccgaagacggggctgtcacggaaggccccggcggggcagac

SEQ ID NO: 115 - protein, 306 aa, Micromonospora carbonacea
  evbM
VPPPQSLLRRLYTEPPEKFVATRDAAVAEARRSGDPATAREIARLRRPTVAAWLVNLLALRRPELVADLTQLAEALRRAQRDLRGPRLRELSAQRRAAVAALVAEARRLAADAEGGPPAGKLPLGEVEATLDAALSDTEVAGQVRSGRLLRAASYAGFGEVPRPQLRLVTGGEEQPPPTHPPPRAKRAAREAERAARAERARQRRMLERELARARTDQERAEAELAGAVEAEHDGAEELTGIERSLAELERSRAEAEQELSRRKLARRAAERAVTAAQRRTGEIEGAIEAVDAEDGAVTEGPGGAD

SEQ ID NO: 116 - DNA, 627 bp, Micromonospora carbonacea
  CDS (1)..(627): evbN
atgcagctcaccaaattcgcccactcctgcctccgcgtcgagcacgacggcggtgtgctggtcgtcgacccgggcgtcttcagcgacccgaccgcgctggacggtgcggacgcggtgctgatcacccatgagcaccccgaccacgtggacgtcgcggctctcacccggcagctcgaccgctggccgttccgcatctacggcccggcctcgctggccggtgccctcggcgacgtggccgaagccctggagcccatctcacccgggcaggcgttcaccgcggcgggcgtggcggtgcgcgcgtacggcggtcggcacgccgtcatccatcccgacatcccggtcgtggacaacctcgggtatctgctgaacgacgtcgtctaccaccccggcgacgccctggtggcacccgaggacgcccccgtggacaccctcttcgcgccgatccacgccccctggtcgaagttctccgaggtgctcgacttcatccgcgcggtcgccccgcgccgagccttcgccctgcacgacgggctgctcaacgacaacggcctcgccgtcctcaaccgtcagtacgccgcgctgtcggggaccgactaccagcgcctcgagccgggcagccggctcgacgtc

SEQ ID NO: 117 - protein, 209 aa, Micromonospora carbonacea
  evbN
MQLTKFAHSCLRVEHDGGVLVVDPGVFSDPTALDGADAVLITHEHPDHVDVAALTRQLDRWPFRIYGPASLAGALGDVAEALEPISPGQAFTAAGVAVRAYGGRHAVIHPDIPVVDNLGYLLNDVVYHPGDALVAPEDAPVDTLFAPIHAPWSKFSEVLDFIRAVAPRRAFALHDGLLNDNGLAVLNRQYAALSGTDYQRLEPGSRLDV

SEQ ID NO: 118 - DNA, 690 bp, Micromonospora carbonacea
  CDS (1)..(690): evbO
atgcgggtgcgggtggacgatgtggacgccgccgcccggtccgccatcacggcggtcaccggcgtcggcggcttcgtcggcggcgacgagcgcagcagcggcggaaccgccgacgcccgggcggagttgcaactgcgggtgccggcggagcggttcacggccgtcctggaggagttggcgaggctcggccggcaggagcagcgggcgatccgcacggaggacgtgaccgaggagaccgtggatctcgacgcgcggatcgccacccaacgggcccgggtcgagagcggtcgcaagctgctggcgcgggccacctcgatcggcgacctggtgacgctggagagcgaggtggctaggcgggaggccgacctcgcctcgctggaggcgaagaagcgccggctggccgacctgacctcgctctccaccatcaccctcaccctggtcggtccggaggcggaggcccgggacaccgagcccgacaccggcttcgtggtcggcctgcgcggcggctggacggcgttcgtcgcctcgctgggcgtgctgctcaccgtgctcggggcgctgctgccgttcgcggtggccctcggcgtgccggtggcggtgctgcttgcggtgctgcggcggcgccggcgtcgaccgccggcgccggccgtcaacgcgccgccgccagtgcccgcagcgcggtctgcacca

SEQ ID NO: 119 - protein, 230 aa, Micromonospora carbonacea
  evbO
MRVRVDDVDAAARSAITAVTGVGGFVGGDERSSGGTADARAELQLRVPAERFTAVLEELARLGRQEQRAIRTEDVTEETVDLDARIATQRARVESGRKLLARATSIGDLVTLESEVARREADLASLEAKKRRLADLTSLSTITLTLVGPEAEARDTEPDTGFVVGLRGGWTAFVASLGVLLTVLGALLPFAVALGVPVAVLLAVLRRRRRRPPAPAVNAPPPVPAARSAP

SEQ ID NO: 120 - DNA, 1260 bp, Micromonospora carbonacea
  CDS (1)..(1260): evbP
gtgacgagtgcgttgacgctgccgaacggcagccacctggcgtcgtcggcctggccggagtcgccgtccgggtcgcagcctttgcccttcgagctcgaccatctgctcgccctccggatgcccggccttatcgccacccgccggcacatccactcccacccggagctctccggcgaggagttcgagacggcggccctgatcgcccgcgagctgtcgctcgccgggttgcgcccgcgcctgctgccaaagggcaacggggtcatctgcgacatcgacggccgccccgacggcccggtggtcgcgctccgcgccgacatcgacgcgctgccgctgaccgacgtcaaggacgtgccctaccggtccaccaaggacggtgtctgccacgcctgcggccacgacgtgcacaccaccgtgctgctcggcgtcggcgtgctgctggcccaactcgccaacctcggcgaattggacggccgggtccggctgatcttccagccggccgaggagatcctgccctgcggctcgctggaggtcatcgaggccggcggtctcgacgacgtcgtgcagatcttcgcactgcactgcgaccccaaccagcccgtcggcaaggtcggcctgcgggtcggcccgatcaccgccgccgccgacaacgtcaccgtccggctcaccggccccggcgggcacaccgctcgcccgcacctgaccgtcgacctggtcgacgcgctcggccggctggtcaccgaggtgccagccctggtcagccgccgggtgccggccaacagcgggctgctgctcgtgttcggccacgcctcggccggcacccggtacaacgtgatcccgtccgaggcgtccgcgtccggcaccctgcgggtgatggaccgcgacacctgggaccaggcccccaagatcgtcgctcaggtggtgcgggacgtcatcgcccccaccggcgccaccgtcgacctggagtacctacgcggccggccgccggtgaccaacgacgcccgggcgatccaggtgctcacggcggcgacccacgccgcgctcggcccggagggggtcgcggagaccccgcagagcatgggcggcgaggacttctcctggtacctggagtacgtccccggcgcgctggcccgcctcggcgtcggccggtccggcccgaacgtcgacctgcaccgggcctcgttcgacgtcgacgagggggccatcgcggtcggcatccgggtcatggtgcagaccgcgctgcgggcactggcggcggcgcgt

SEQ ID NO: 121 - protein, 420 aa, Micromonospora carbonacea
  evbP
VTSALTLPNGSHLASSAWPESPSGSQPLPFELDHLLALRMPGLIATRRHIHSHPELSGEEFETAALIARELSLAGLRPRLLPKGNGVICDIDGRPDGPVVALRADIDALPLTDVKDVPYRSTKDGVCHACGHDVHTTVLLGVGVLLAQLANLGELDGRVRLIFQPAEEILPCGSLEVIEAGGLDDVVQIFALHCDPNQPVGKVGLRVGPITAAADNVTVRLTGPGGHTARPHLTVDLVDALGRLVTEVPALVSRRVPANSGLLLVFGHASAGTRYNVIPSEASASGTLRVMDRDTWDQAPKIVAQVVRDVIAPTGATVDLEYLRGRPPVTNDARAIQVLTAATHAALGPEGVAETPQSMGGEDFSWYLEYVPGALARLGVGRSGPNVDLHRASFDVDEGAIAVGIRVMVQTALRALAAAR

SEQ ID NO: 122 - DNA, 1581 bp, Micromonospora carbonacea
  CDS (1)..(1581): evbQ
atgagtgaaccgcggtcgagcgagtccggcttcccgatcaagggtgtctacacccagagggacctgccggagggtctgcccgagcggctgggcgagccgggggagttcccgtacacccgtggggtctactccaccatgtacacctcgcggccgtggacgatgcgccagtacgccggcttcggcaccgcgacggagagcaacgcgcgctaccaccagctcctgcgcgccggcaccatgggcctctccgtcgcttttgatctgcccacccagatggggtacgactcggacgacccgatcgcccacggcgaggtcggcaaggtcggcgtcgccatcgactcgatcgaggacatgcggctgctgttccacggcatcccgttggacaaggtttccacctcgatgacgatcaacgccccggggtcggtgctgctgctgctctaccagctcgtcgccgaggaggcgggggtgccgggcgcggcgctcaacggcaccatccagaacgacatcctcaaggagtacatcgcccggggcacgtacatcttcccgccgaagccctcgctgcggctggtcgccgacacgttcgcctactgccgggcggaggtgccgaagtggaacaccatctccatctccggctaccacatggccgaggccggcgcgtcgcccgcgcaggagatcgcgttcacgctggccaacggcgtcgagtacgtccgggccgcgctcgccgccgggctggcggtggacgacttcgcgccccggctgtcgttcttcttcgtcgcccggaccaccctgctggaggaggtcgcgaagttccgtgccgcccggcggatctgggcccggctgatgcgcgacgagttcggcgcgaagaacccgaagtcgatgatgctgcgcttccacacccagacggcgggcgtgcagctcaccgcccagcagcccgaggtgaacctggtccgggtggcgatccaggggctgggcgcggtgctcggcggcacccagtcgctacacacgaacagcttcgacgaggccatcgcgctgcccaccgagaaggccgcccggctggcgctgcgcacccagcaggtgctcgcgtacgagacggacctgaccgccaccgtcgacccgttcgccgggtcgtacgtggtggaggcgatgaccgccgagatcgaggcggcggtggtggagctgatggagcgggtggccgaccacggctcggtggtcgacgccatcgaggcgggcttccagaagcgggagatcgagcagtccgcgtaccggatcgcccaggagatcgactcgggcgagcgggtggtggtcggcctcaaccggttcacggtcgacgccgacgagccgtacgagccgctgcgggtggacccgacgatcgaggctgcccaggccgagcggctggccaagctgcgagtggagcgcgacagcgacgccgtcgagcgcgcgctgggtgagctgcgggccgccgccgagggtacggcgaacgtgctgcacccgatgaaggaggcgctgcgggcccgggccacggtgggcgaggtctgtggcaccctgcgccaggtgtgggggacgtaccgccccagcgaccggttc

SEQ ID NO: 123 - protein, 527 aa, Micromonospora carbonacea
  evbQ
MSEPRSSESGFPIKGVYTQRDLPEGLPERLGEPGEFPYTRGVYSTMYTSRPWTMRQYAGFGTATESNARYHQLLRAGTMGLSVAFDLPTQMGYDSDDPIAHGEVGKVGVAIDSIEDMRLLFHGIPLDKVSTSMTINAPGSVLLLLYQLVAEEAGVPGAALNGTIQNDILKEYIARGTYIFPPKPSLRLVADTFAYCRAEVPKWNTISISGYHMAEAGASPAQEIAFTLANGVEYVRAALAAGLAVDDFAPRLSFFFVARTTLLEEVAKFRAARRIWARLMRDEFGAKNPKSMMLRFHTQTAGVQLTAQQPEVNLVRVAIQGLGAVLGGTQSLHTNSFDEAIALPTEKAARLALRTQQVLAYETDLTATVDPFAGSYVVEAMTAEIEAAVVELMERVADHGSVVDAIEAGFQKREIEQSAYRIAQEIDSGERVVVGLNRFTVDADEPYEPLRVDPTIEAAQAERLAKLRVERDSDAVERALGELRAAAEGTANVLHPMKEALRARATVGEVCGTLRQVWGTYRPSDRF

SEQ ID NO: 124 - DNA, 2088 bp, Micromonospora carbonacea
  CDS (1)..(2088): evbR
atgggcacggtctggcgtgccacagacaccctgctgcggcgcgacgtggcggtgaaggaggtcgtcctcccgcccggcctcgccccgagcgaccgcgacgccatgtacgaacgcacgctgcgcgaggcccgcgcggcggcggccatccagcacccggccgtggtccaggtgtacgacgtggtcaccgagggtggtcgcccctggatcgtgatggagctgctggacgcccgcagcctggccgacatggtgatcgaggacgggccggtggccccccgcgcggtcgccaagatcggcatcgccctgctcggcgcgctggaggtggcccacgcgatcggggtgctgcaccgcgacgtgaagccggccaacgtgctgatctgcaccgacggccggtgcgtgctgaccgacttcggggtggccaagctccccaccgacgtgcagctcaccacgccggggatggtgctcggctcgccgcacttcatctcccccgagcgggccatgggccaggagttcggcccgccgagcgacctgttctccctcggcgtcacgctctacacggcggtggagggccggcccccgttcgacaggggcgacccgatcgagaccatgcacgccgtggtcgaggacccgccggccacgccgcagcgcagcggcccgctgacccgggtgctgatggggctgctggagaaggacccggcccgccgcctcgacgtgcacaccgcccgcgcgatgctccgcgagctgctcgccggcccgctgaccagcaccgccaccgccgtcaactcggtcaccgacccgtacgcggtggtgccggtcaagcagcgcccggccgtcgccccaccgccctccgctgcggagccgaagccgagcgggcagatcggcggccgggcgatgctcgcccccggcgagtcgctgaccgaccggctggcggccctgcgccggggcgagaagacgaggaagaggaagacgacgaccgccgccgcgctggacgacaccagcgccgacgcgcttgccggcccgctgcacacccccaccggggcgatgcccgcgcccccgcccgccggccggacgtacggcggttcgtcggaggccacccagcgggtcgacgcggggaccgcgccggaggccacccagcggatgacgtacggcagcccgcccgacgccacccagcgggtgtcccacgggagcggcccgtcggaggccacccagcgggtgccctacggcggcggctcggcggacgccacccagcaggtgcccttcggtcgccggcccgacgcgacgcagcgggtcccctacggcagccagcccggcgcgacgcagccggtccccggcttcggcgcgtcgccggacgccacccagcgggtcggcggggcgtacggcggcggccagtggtcggtgcccggcaccggccagccgtgggccaccccggccaccgcgcccgccccggccaccgccggcggcggcggggtcggccgcctcgtcgccacggtcaagggctggccgcgcaaggtgcagctcgccgcggccggcggcgtcgccgtgctgctgctgatcggcgtgttcgccctcttcggcggcgacgacccggagcagccgaccaccccgcaggggcagccgagcgccggggcgcccgccggccccggggtggagatgcaggagcagtcggccaagggcgtcacggtgcaggtgcccaagggctgggagcggcgcagtgccgacgggggcgtgtgggtcgactacatcgatccggaggacaacagccgcaaggtgcgcatcctcgccgagcggtggagcggcacgtcgacgcgctgggccgagaccgccgcgaacgggctgcggacccggtcggcctcctgccagaagccgtacaaccaggtgtcgatgaccgagcaggagctcgacggcaaggcggcggccgagttcgagtacacctgcggcgacggcgagggcaagcggcacggcgtgtggcgcggggtggtgcacgagggcaaggtctactcgttctacctctcctcgaccgacgcccgcttcgccgagagcaagccgatcttcgatcagatggtggcgtcgttcaagctccgcgggagcgac

SEQ ID NO: 125 - protein, 696 aa, Micromonospora carbonacea
  evbR
MGTVWRATDTLLRRDVAVKEVVLPPGLAPSDRDAMYERTLREARAAAAIQHPAVVQVYDVVTEGGRPWIVMELLDARSLADMVIEDGPVAPRAVAKIGIALLGALEVAHAIGVLHRDVKPANVLICTDGRCVLTDFGVAKLPTDVQLTTPGMVLGSPHFISPERAMGQEFGPPSDLFSLGVTLYTAVEGRPPFDRGDPIETMHAVVEDPPATPQRSGPLTRVLMGLLEKDPARRLDVHTARAMLRELLAGPLTSTATAVNSVTDPYAVVPVKQRPAVAPPPSAAEPKPSGQIGGRAMLAPGESLTDRLAALRRGEKTRKRKTTTAAALDDTSADALAGPLHTPTGAMPAPPPAGRTYGGSSEATQRVDAGTAPEATQRMTYGSPPDATQRVSHGSGPSEATQRVPYGGGSADATQQVPFGRRPDATQRVPYGSQPGATQPVPGFGASPDATQRVGGAYGGGQWSVPGTGQPWATPATAPAPATAGGGGVGRLVATVKGWPRKVQLAAAGGVAVLLLIGVFALFGGDDPEQPTTPQGQPSAGAPAGPGVEMQEQSAKGVTVQVPKGWERRSADGGVWVDYIDPEDNSRKVRILAERWSGTSTRWAETAANGLRTRSASCQKPYNQVSMTEQELDGKAAAEFEYTCGDGEGKRHGVWRGVVHEGKVYSFYLSSTDARFAESKPIFDQMVASFKLRGSD

SEQ ID NO: 126 - DNA, 1728 bp, Micromonospora carbonacea
  CDS (1)..(1728): evbS
atggcggcggacaccactgacctcgacgacacgcgcgatctggacgaccttcgcgaccgggcccggcggtggctcgacgacgaccccgacccggccacccgcgacgagctggaggccgtgctcgacgggctgccggcgagcgcggccgagctggccgaccggttcgccgggccactgaccttcggcaccgccgggctgcgcggcccgctgcgcgccggccccaacgggatgaacctcgccgtggtcacccaggccgccgccgggctcgtcgcctggctcgccgcccaggacgccaccgggccgctggtcatcgggtacgacgcccggcacggctcgcgggagttcgccgagcgcaccgcccaggtggccaccggcgcgggccgcccggcgctgctgctgccccgcccgctgcccacccccgtgctggcgtacgcggtgcggcagctcgacgcggcggccggcgtgatggtgaccgccagccacaacccgccccaggacaacggctacaaggtctacctcggcgcgcagctcggcggcgagctgggcgcgggggcgcagatcgtgccgccggccgacaccggcatcgaggccgccatccgggcggtcggcccgctggccgacgtaccgctgggcccggccgggcaggtcgtcggcgacgacgtggtcgtgtcgtacgtcgaccgggccgccgccgtggtcgacccggcggggccccggagcctgaaggtggcctacacgccgctgcacggcgtgggcgcggccgtgctgaccgccgccttcgcccgcgccggcttcggcatccccggcgtggtgcccgagcaggcggtgccggacccggacttccggaccgtcagcttccccaacccggaggagccgggggcggtggacctcctcgtcgcgctcgccgagcgcaccggggcggacctggcgatcgccaacgaccccgacgcggaccgctgcgcggtggccgtccgcgacggccgggcggcgggcccggcaccggtgagtgggggcgcctggcggatgctgcgcggggacgaggtgggggcgctgctcgccgaccatctcatgcgccgtggcgtccacggcctgtacgccaccaccatcgtgtcgtcgtccctgctacgggccatgtgcgccgcccgtggcctgccgtacgacgagacgctgaccggcttcaagtggatcgtccgggccggcggcggaccgctgggtgaggccggctccgacccgctggtcttcggctacgaggaggcgctgggctactgcgtcgccccggagcacgtccgcgacaaggacggcatcaccgccgcgctgaccgtcgccgagctggccgccgggctgaaggcgcaggggcgcaccctcaccgaccggctcgacgagctggccgccgagttcggcgtgcaccacaccgaccaactctcggtgcgggtggacgacctgcgcatcatcgccgacgcgatggcccgggtccgggcggccaccccgacgaccctgctcggccgcccggtgaccgaggcgcgggacctgctccccgaggcggacgtggtgatcctgcgtaccgacggggcacgggtggtgatccgcccgtcgggcaccgagccgaagctcaaggcgtacctggaggtggtggagccggtggcggacggcgacgtgccggcggcccggacgcgcgcggcggccacgctggcggcactccgcacggaaatcgccgccctggtgcaggga

SEQ ID NO: 127 - protein, 576 aa, Micromonospora carbonacea
  evbS
MAADTTDLDDTRDLDDLRDRARRWLDDDPDPATRDELEAVLDGLPASAAELADRFAGPLTFGTAGLRGPLRAGPNGMNLAVVTQAAAGLVAWLAAQDATGPLVIGYDARHGSREFAERTAQVATGAGRPALLLPRPLPTPVLAYAVRQLDAAAGVMVTASHNPPQDNGYKVYLGAQLGGELGAGAQIVPPADTGIEAAIRAVGPLADVPLGPAGQVVGDDVVVSYVDRAAAVVDPAGPRSLKVAYTPLHGVGAAVLTAAFARAGFGIPGVVPEQAVPDPDFRTVSFPNPEEPGAVDLLVALAERTGADLAIANDPDADRCAVAVRDGRAAGPAPVSGGAWRMLRGDEVGALLADHLMRRGVHGLYATTIVSSSLLRAMCAARGLPYDETLTGFKWIVRAGGGPLGEAGSDPLVFGYEEALGYCVAPEHVRDKDGITAALTVAELAAGLKAQGRTLTDRLDELAAEFGVHHTDQLSVRVDDLRIIADAMARVRAATPTTLLGRPVTEARDLLPEADVVILRTDGARVVIRPSGTEPKLKAYLEVVEPVADGDVPAARTRAAATLAALRTEIAALVQG

SEQ ID NO: 128 - DNA, 858 bp, Micromonospora carbonacea
  CDS (1)..(858): evbT
gtgccgcgacggcagctcggcaggctgctcacccagctccgcgagagcgcccatatcagcatcgacgcggcggccggcgagctggactgctcgcggcagaagctctggcggatcgagcgggggctgacctcggccaagacaccggacgtccgggtgctctgcgagctgtaccgggccacgcccgaccaggcgagcgtgctgctcgggctcgccgaggtgagccgggccgaggggtggtggcacgcccacggcagctccgtgccggcctggttctcgctctacgtcggcctggagaacgtcgcgagcagcattcggcactacaacgcggagctggtgccggggctgttgcagacccccggctacgccaccgcgctcttcgagcacaaccggcccgagctgggcgaggaggagcgaaagaaggcggtgggcttccggactcagcggcaggggctgctggcccggcggctgcccccggcccccgagctgaccgtgatcctcagcgaggcggtgctgcgccgcccggtgccgggccgatcggtgatggccgaccagctccggcacctgctggccgtcggcgaacggcacaacatcaccgtacgggtgctgccgctggccgccgggccgccgctggccgccgaggccggcacgttcgtgctgctcgacttcccgctctcggcgctcggcagcccgaccgagccgccgaccgtctacgtcgaggggctcaccggcgcgctctacctcgaccagccgacggagatcgccgcgtacgaacgggtctggaggggtctggattcgctcgccctcggcgcgcgacaatcagcggagctgatcgatgccatccggggagagtgctatgag

SEQ ID NO: 129 - protein, 286 aa, Micromonospora carbonacea
  evbT
VPRRQLGRLLTQLRESAHISIDAAAGELDCSRQKLWRIERGLTSAKTPDVRVLCELYRATPDQASVLLGLAEVSRAEGWWHAHGSSVPAWFSLYVGLENVASSIRHYNAELVPGLLQTPGYATALFEHNRPELGEEERKKAVGFRTQRQGLLARRLPPAPELTVILSEAVLRRPVPGRSVMADQLRHLLAVGERHNITVRVLPLAAGPPLAAEAGTFVLLDFPLSALGSPTEPPTVYVEGLTGALYLDQPTEIAAYERVWRGLDSLALGARQSAELIDAIRGECYE

SEQ ID NO: 130 - DNA, 606 bp, Micromonospora carbonacea
  CDS (1)..(606): evbU
atgccgcggatcagcctcgacctcgggatggccgccgccgtcctgatcgagctggccctcgccggccgggtcgcgtacgtcgatgggaacctggtggtcacggaccccgcgcccaccggcgaaccgatcctggacgaggtcctgggccggatggccgccgacacgccgcacaccccgtcctcctgggtgcagcggctgcgccacggcctgcgcgaccggatcctcggcgacctggtcgcccggggcgtggtgcgcgacgtcgaggagaccgagctgggcttcatccacgtgcaccgctacccgacggcggacgccaccgtggaggaggactcccggcggcggctggccgaggcgctggccggcgggcagatccccgacgaggcgacggcggcgctggccaccctggtcgcggtgctccggatggagccggcgctcggcctgaccggcgacgccgccgtcgacgcccggcgtcggctggaggagatcgcgggcggggccggcttctccggcaccgtcagcctggacgactcggtggtccgcccctcggtggccctggtcgtcaccgccctgggcaaggcggtcgacgccgccctcggcaagcgcgcc

SEQ ID NO: 131 - protein, 202 aa, Micromonospora carbonacea
  evbU
MPRISLDLGMAAAVLIELALAGRVAYVDGNLVVTDPAPTGEPILDEVLGRMAADTPHTPSSWVQRLRHGLRDRILGDLVARGVVRDVEETELGFIHVHRYPTADATVEEDSRRRLAEALAGGQIPDEATAALATLVAVLRMEPALGLTGDAAVDARRRLEEIAGGAGFSGTVSLDDSVVRPSVALVVTALGKAVDAALGKRA

SEQ ID NO: 132 - DNA, 579 bp, Micromonospora carbonacea
  CDS (1)..(579): evbV
atgcgggacgcgcgcaccgactcctccaacttccgggccgcgctgcacgagctcaccaccatgctcgtgtacgaggccgcccgctccttccccgtcgagaagtacccggtgcagacccccgtcaccgacgccgagggcacccggctggccaacccgccgctgctggtacccgtgctgcgggccggtctcggcatggccgacgccgcgctcgccctgctccccgagtcgtccatgggcttcgtcggcctcgcccgcgacgaggagacgtacgagccgcgcgcgtacatggagtcgctgccgcgcgacctcgccggcctgcccgtgctggtcctcgacccgatgctggccaccggcggctccctggagcactgctgccggctgctggccgagcggggctgcaccgacatcaccgtgctctgcgtgctcgccgcgcccgtcggcatcgcccggctggagcagtccggcctgccgctgcgcctcgtcaccgccgcgatcgacgagagcctcaacgaccggatgttcatcgtgccgggcctcggcgacgccggcgaccgccagttcggcggtatgccccgcttc

SEQ ID NO: 133 - protein, 193 aa, Micromonospora carbonacea
  evbV
MRDARTDSSNFRAALHELTTMLVYEAARSFPVEKYPVQTPVTDAEGTRLANPPLLVPVLRAGLGMADAALALLPESSMGFVGLARDEETYEPRAYMESLPRDLAGLPVLVLDPMLATGGSLEHCCRLLAERGCTDITVLCVLAAPVGIARLEQSGLPLRLVTAAIDESLNDRMFIVPGLGDAGDRQFGGMPRF

SEQ ID NO: 134 - DNA, 1014 bp, Micromonospora carbonacea
  CDS (1)..(1014): evbW
atgacggcgacagcgacgtcggcccggtcggacctctccgagctgggacgatccgagaccgctttgcggaacttcctgcacggcctgccgggcgtggaccaggtcggcgcggagcagcgggcggcccagctcggcacccgctcgatcaagaccacggccaaggcccgggcgatcgacctggcgatccggatggtcgacctgaccaccctggagggggccgacacccccggcaaggtgcgggcgctcgcggccaaagcactgcgccccgacccggccgacccgtcctgcccgcacgtcggcgcagtctgcgtctacccggcgatggtcccgtacgtggccgaggtgctgcgcggatccgccgggtccgggcggccgtccggcggaccggacggcaacgcgccggccggacccggcgtggtgcacctggccagcgtggccaccgcgtttccgtccgggcaggcacccctggaggtcaagctcgccgacacccgggccgcagtggcggctggcgcggacgagatcgacatggtgatcaaccggggcgcgttcctggccggccgctaccgcgaggtctacgacgagatcgtggccaccaaacaggcgtgcggggacgcccacctcaaggtgatcctggaaaccggcgagctggccacgtacgacaacgtgcgccgggcgtcctggctggccatgctggccggcggcgacttcatcaagacctcgacgggcaaggttcccgtcgcggcgaccctcccggtgacgctggtgatgctggaggcggtccgcgacttccgcgccgccaccgggcggcaggtcggcgtgaagccggccggcggcatcaagaacaccaaggacgcgatcaagtacctggttatggtcaacgagaccgtcggcccggactggctggacccggactggttccggttcggcgcgtccagcctgctcaacgacctgctcatgcagcgcaccaagctgacgaccggcgtctactccggtcccgactacttcaccctggac

SEQ ID NO: 135 - protein, 338 aa, Micromonospora carbonacea
  evbW
MTATATSARSDLSELGRSETALRNFLHGLPGVDQVGAEQRAAQLGTRSIKTTAKARAIDLAIRMVDLTTLEGADTPGKVRALAAKALRPDPADPSCPHVGAVCVYPAMVPYVAEVLRGSAGSGRPSGGPDGNAPAGPGVVHLASVATAFPSGQAPLEVKLADTRAAVAAGADEIDMVINRGAFLAGRYREVYDEIVATKQACGDAHLKVILETGELATYDNVRRASWLAMLAGGDFIKTSTGKVPVAATLPVTLVMLEAVRDFRAATGRQVGVKPAGGIKNTKDAIKYLVMVNETVGPDWLDPDWFRFGASSLLNDLLMQRTKLTTGVYSGPDYFTLD

SEQ ID NO: 136 - DNA, 1431 bp, Micromonospora carbonacea
  CDS (1)..(1431): evbX
gtgatcttcgaatacgcgcccgcccccgagtcccgctcggtggtggacctcaagccctcgtacgggctgttcgtcgacggggagttcgtcgacccggccgacggcggcggcttcaagtcggtcaaccccgcctccgaggaggtgctcgccgagatcgccgaggcgggcagcgccgacgtggaccgggcggtccgcgccgcccggacggcgtacgagaaggtgtggggcccgatgccgggccgggaccgggccaagtacctgttccggatcgcccggatcatccaggagcgctcccgcgagctggccgtgctggagtccctggacaacggcaaaccgatccgggagtcccgggacgtcgacctgccgctggtcgccgcgcacttcttctactacgcgggctgggcagacaagctgccgtacgcgggcttcggcccgaacccccggccgctcggcgtggccgcgcaggtcatcccgtggaacttcccgctgctcatgctcgcctggaagatcgccccggcgctggccgccggcaacacggtggtgctcaagccggcggagaccaccccgctgaccgcgctgctgttcgccgagatctgccagcaggccgagctgccggccggcgtggtcaacatcgtcaccggcgcgggcgacaccggccgggcgctggtcgagcacccgggcgtggacaaggtcgcgttcaccggctcgaccgaggtcggcaaggccatcgcccggtccgtcgcgggcaccggcaagaaggtcaccctggagctgggcggcaaggccgcgaacatcgtcttcgacgacgccccggtcgaccaggcggtcgaggggatcgtcaacggcatcttcttcaaccaggggcacgtctgctgcgccgggtcgcggctgctggtccaggagtcggtcgccgagcaggtgctggagtcgctgaagcgccgaatggcgctgctgcgggtcggcgacccgttggacaagaacaccgacatcggggcgatcaactcggccgcccagctcgcccgcatccgcgagctgtccgccgcgggcgaggccgagggggcggagcgctggtcgccgccgtgcgagctgcccgagcgcgggttctggttcgcgccgacgatcttcacgggggtcacccaggcgcaccggatcgcccgggaggagatcttcggtccggtgctgtccgtgctgaccttccgcaccccggccgaggccgtcgagaaggccaacaacacgccgtacgggctgtcggccgggatctggaccgacaagggctcccggatcctgtggatggccgaccggctgcgcgccggggtggtgtgggccaacacgttcaacaagttcgacccgacctcgccgttcggcgggtacaaggagtcgggctacggtcgcgagggcggccggcacgggctggaggggtacctcggtgtc

SEQ ID NO: 137 - protein, 477 aa, Micromonospora carbonacea
  evbX
VIFEYAPAPESRSVVDLKPSYGLFVDGEFVDPADGGGFKSVNPASEEVLAEIAEAGSADVDRAVRAARTAYEKVWGPMPGRDRAKYLFRIARIIQERSRELAVLESLDNGKPIRESRDVDLPLVAAHFFYYAGWADKLPYAGFGPNPRPLGVAAQVIPWNFPLLMLAWKIAPALAAGNTVVLKPAETTPLTALLFAEICQQAELPAGVVNIVTGAGDTGRALVEHPGVDKVAFTGSTEVGKAIARSVAGTGKKVTLELGGKAANIVFDDAPVDQAVEGIVNGIFFNQGHVCCAGSRLLVQESVAEQVLESLKRRMALLRVGDPLDKNTDIGAINSAAQLARIRELSAAGEAEGAERWSPPCELPERGFWFAPTIFTGVTQAHRIAREEIFGPVLSVLTFRTPAEAVEKANNTPYGLSAGIWTDKGSRILWMADRLRAGVVWANTFNKFDPTSPFGGYKESGYGREGGRHGLEGYLGV

SEQ ID NO: 138 - DNA, 735 bp, Micromonospora carbonacea
  CDS (1)..(735): evbY
gtgcaatccgcgaacgtgtcgctggcctcccgcaaggacgcgcgggacgccgtggtcgccgcccgcgccgccgtgaagggctgggccggggcgaccgcgtacaaccggggtcagatcctctaccgggtcgccgagatgctggagggccgccgcgagcagttcgtcgcgctcggcgtgccggccgacgaggtcgacgcggcgatcgaccgctgggtctggtacgcgggctggtccgacaagctcccccaggtgtacggcggtgcgaaccctgtcgccgggccgtacttcaacctgtccgcgcccgagccgacgggggtggtggccgtggtggcccccgaggcccccgcgctgctcggcctggtcagcgtgatcgccccggcgatcgtcaccggcaacacggtggtggtggcggcctcgccgacccagcccctggcctcggtgaccctggccgaggtgctggccacctccgacctgcccggcggggtggtcaacgtcctgaccggtgcgatcaccgagacggtgccgacgctcgcggcgcacctggacgtcaacgcgatcgacctgaccggggtgggcgacgcgtcgctcgccaccgagctggaggtcagggcggcggagaacctcaagcgggtgattcggccggccccggccgaccacgactggtacgccgacccgggcctcacccggatgacgacgctgctggagacgaagacggtctggcaccccaagggcgtc

SEQ ID NO: 139 - protein, 245 aa, Micromonospora carbonacea
  evbY
VQSANVSLASRKDARDAVVAARAAVKGWAGATAYNRGQILYRVAEMLEGRREQFVALGVPADEVDAAIDRWVWYAGWSDKLPQVYGGANPVAGPYFNLSAPEPTGVVAVVAPEAPALLGLVSVIAPAIVTGNTVVVAASPTQPLASVTLAEVLATSDLPGGVVNVLTGAITETVPTLAAHLDVNAIDLTGVGDASLATELEVRAAENLKRVIRPAPADHDWYADPGLTRMTTLLETKTVWHPKGV

SEQ ID NO: 140 - DNA, 411 bp, Micromonospora carbonacea
  CDS (1)..(411): evbZ
atggacgtgctgtgggacaccgtcccgggcacgtcggacggggtgacggtgcgcgaggtcgccgaggccctcgacggccgcgagctggcgtacacgacggtgatgaccgtgctggaccggctcgccggcaagggcatggtgcggcgccagcgggaggggcgggcctggcgctaccaggccgcggccagccgcgaggcgcacatcgcccagctcatgctcgacgcgctggacctcggcggcagccgggacgccgcgctggtgcgcttcgcccggtcggtgaccggcaccgaggccgaggtgctgcgcgccgccctcggcgccgaggcgggcggcccgctgaccgaccgcgtcgacgcgccgcgcgccgaccgggccgggcagccggccctggccgacgaggcgacggaccgg

SEQ ID NO: 141 - protein, 137 aa, Micromonospora carbonacea
  evbZ
MDVLWDTVPGTSDGVTVREVAEALDGRELAYTTVMTVLDRLAGKGMVRRQREGRAWRYQAAASREAHIAQLMLDALDLGGSRDAALVRFARSVTGTEAEVLRAALGAEAGGPLTDRVDAPRADRAGQPALADEATDR

SEQ ID NO: 142 - DNA, 903 bp, Micromonospora carbonacea
  CDS (1)..(903): evcA
atggcgtacgccgtgcacttcgccgcgacggtcctggcctgctacctgaccgctcaggtcctggcggcgtccacctggacgtggcgggccccccggatcgcgatcgtctgctggcaggcggtcgggctcgcgctcgggctctccgcgatgggcctgccgatggcgctcggcgtggccgcgtacgaccggccgaccggcagcgcgttgctcgccctggccaccgacctgacccacggcaccctgccggccgggctcggcgcggtccacctcggtctggtcggggtcgggttcggcatcggggcggcgctgctcgccacgacggtacgcagcgtgcaggcgaccgtccgggcccagcggcagcaccgggacctgctcgccctggtggcccggcgggacccggaggtgccgggggcgctggtgctggaccatccgagcgcggcggcgtactgcctgccgggcgtgcggccccgggtggtggtcagcgccggggcgctcagcatgctcgaccgggccgagctggcggcggtgctgacccacgagcgggcgcacgcccaggagcgccacgaccttgtgctgctgccgttcaccgcgctgtgccgtgcgctgccctggttccgttgggtacgcgacgcgcacgagcgggtcgccctgctggtcgagatgcgcgccgacgacaaggcccgggagctgcacgccgaggctcccctcgcgggggcgttgcgccggttcgccgcggccggccaccggatcgcgccggccggcaccctcggcctgggcgaccgggacctggacgtccgggtccagcggctgctggtcgccgaccggccgccccggctgatcggggccgccgcgctggcggtggcggtcaccctggtcgcgctgccggtctccctcttcctgagc

SEQ ID NO: 143 - protein, 301 aa, Micromonospora carbonacea
  evcA
MAYAVHFAATVLACYLTAQVLAASTWTWRAPRIAIVCWQAVGLALGLSAMGLPMALGVAAYDRPTGSALLALATDLTHGTLPAGLGAVHLGLVGVGFGIGAALLATTVRSVQATVRAQRQHRDLLALVARRDPEVPGALVLDHPSAAAYCLPGVRPRVVVSAGALSMLDRAELAAVLTHERAHAQERHDLVLLPFTALCRALPWFRWVRDAHERVALLVEMRADDKARELHAEAPLAGALRRFAAAGHRIAPAGTLGLGDRDLDVRVQRLLVADRPPRLIGAAALAVAVTLVALPVSLFLS

SEQ ID NO: 144 - DNA, 1248 bp, Micromonospora carbonacea
  CDS (1)..(1248): evcB
atggatcaactgctcctcgcccgtctccagttcgccacgaccacctcgctgcacttcctcttcgtcgtcgtcacgctcggtctggtcaccctgctcgtcgggctccagacggcctggacgatcaccggcaatcccgtccacgagcggctgacccggttctggggtcagctctacgtgatcaactacgtgctcggcatcgccaccggcctgctcatggagttccagttcgggctgaactggagcggcctgtcgcgctacgtcggcaacgtcttcggcgccccgctggcgatcgagaccctggtcgcgttcttcctggagtccacgttcctcgggatgtggatcttcggctggcaccggctgcgccggggcgtgcacctcgcgctgctgtggggcgtggcgctgaccgcgtacgcctcggcgttctgggtcatggtggcgaacgcctggctgcagaacccggtcggctacgaggtgcgcgacggggtggcccacctgaccgacttcggcgcgttgctgaccaatcccaccttcggcctggccttcgggcacgtggtcgccgccgccctgctcaccggcgggatgctgatggcggcggtgagcgcctggcacctgatccggcgcaccccggaccacgcgctgttccgcacgtcgctgcggatcggcctggtcaccgcggcggtctcgatcagcctggtgcagggcttcggcttcgcccagttcgggccggtcgggcagacgcagcccaccaagttcggcggcggcgcgcagcgcgacgccctggtcgccgaatggacctcccggttcgggcccggcgactacaccccgcccgtgctggccgacgtcgggctcggtttcatgatcctgatcggcctcctcctgggctgtctgtggctgctgctccccctgctctggcgggactggttcatccggctgcgcttcccgctctggctgatcctgctggcgctgccgctgcccttcgtcgcggtgatcctcggctggatcgcccgtgaggtgggccgccagccctgggtcgcgtacgggctgctttccaccgagcgggcggtctcgccggtcgcgcccggggtgatgctcgcctcgctgatcggcttcaccctgctgctcggcgggctcgccgtcgccaactgggtgctgttcgcccggtacgccgcccggggagccgccgatcccgccctaggccgccggcccggcccagccgccgacgagtcccgtcccgtccccgtcctcggc

SEQ ID NO: 145 - protein, 416 aa, Micromonospora carbonacea
  evcB
MDQLLLARLQFATTTSLHFLFVVVTLGLVTLLVGLQTAWTITGNPVHERLTRFWGQLYVINYVLGIATGLLMEFQFGLNWSGLSRYVGNVFGAPLAIETLVAFFLESTFLGMWIFGWHRLRRGVHLALLWGVALTAYASAFWVMVANAWLQNPVGYEVRDGVAHLTDFGALLTNPTFGLAFGHVVAAALLTGGMLMAAVSAWHLIRRTPDHALFRTSLRIGLVTAAVSISLVQGFGFAQFGPVGQTQPTKFGGGAQRDALVAEWTSRFGPGDYTPPVLADVGLGFMILIGLLLGCLWLLLPLLWRDWFIRLRFPLWLILLALPLPFVAVILGWIAREVGRQPWVAYGLLSTERAVSPVAPGVMLASLIGFTLLLGGLAVANWVLFARYAARGAADPALGRRPGPAADESRPVPVLG

SEQ ID NO: 146 - DNA, 1005 bp, Micromonospora carbonacea
  CDS (1)..(1005): evcC
gtggaactcgcctggtacgccctgctcgggctcttcctcgccggctacctggtcctcggcggctacgactacggcgtcggcctgctgctcgcccggggcggcccgccggcccgccgccgggcggccctcaccgccgtgggcccgttcttcctcggcaacgaggtctggctggtggcgaccgtcggcattctgttcggcgcgttccccaccctggagggggaactgctgtccggcttctaccccgtcgtcgccgccgcgctggccggggtgatcatggtgaccgtcggcgtgcaactgcgcagccgcccgaccgacgagccgacccgcgccgcctgggaccggatggtggccgccgggagcctgctcgccgcgttcggctggggggcgctgctcgccgggctgctccagggcgtaccgctggccgccgacgggcacgtcacgggcgtcggccacgtggccaccccgttcgcggccctcgccgggctggcgatgacggccctggtggcggtgcacggtgcgacgttcctcacgctccggctgtcggccgccgacgccgcaccgctggcccgtaccgcccgccggctggtcgcggtggcgctcgccgccgtcgccctggccgccgtcgcgggcgcgctctccgatcgggtacgcgccgcgacgcagcgcccgctgccggccgtactgctgccgttggtactggtggcggcgctgctggtggcccgggcggcgcacgcgcggcacctgcccggggtggccttcgccgccacttcggcggcgctggcgctgccggtggcgggagtcggcgcggcgttgtggccctacgcgctggtctccaccgtcgcaccgacggcatcactgagcgtgaccgacgcggcggccagcgggccgacgctgacggtgctgggctggctggcgctaccgctcctgccggccctactaggcttccaggcgatgtgctggtgggtgttccggggacgaaccgacggcagggcaccggtgtactgg

SEQ ID NO: 147 - protein, 335 aa, Micromonospora carbonacea
  evcC
VELAWYALLGLFLAGYLVLGGYDYGVGLLLARGGPPARRRAALTAVGPFFLGNEVWLVATVGILFGAFPTLEGELLSGFYPVVAAALAGVIMVTVGVQLRSRPTDEPTRAAWDRMVAAGSLLAAFGWGALLAGLLQGVPLAADGHVTGVGHVATPFAALAGLAMTALVAVHGATFLTLRLSAADAAPLARTARRLVAVALAAVALAAVAGALSDRVRAATQRPLPAVLLPLVLVAALLVARAAHARHLPGVAFAATSAALALPVAGVGAALWPYALVSTVAPTASLSVTDAAASGPTLTVLGWLALPLLPALLGFQAMCWWVFRGRTDGRAPVYW

SEQ ID NO: 148 - DNA, 1683 bp, Micromonospora carbonacea
  CDS (1)..(1683): evcD
gtgctcgcggtgctcggcgggctgacggcgctgctggtcgtggggcaggccaccgcgctggccacggtgctggccgccgcgctcgacgggcggttggcccggccggcgctcgccggtttcctggccgccgtggtggggcgggcgctggtcgcctgggcccagggcacggtggcggcgcgggccgccgcgacggtcaaggcggcgctgcgggccgacctgctcgccgccgtcggccggcacggtcccggctgggtcgccgggcagcgggccgggcagctcgccaccctggccgggcgggggctggacgccctggacgcctacttcaccgggtaccttccgcagctcgtgctcagcgtcaccgtcccggtggccgtgctggcccggatcaccttcgccgactggggctcggccgtcatcgtcgcgctgaccctgccgctgatcccggtcttcggggcgctgctcggctggcaggcgcaggccgccaccgagcggcagtggcggcggctgtcgacgctcggcgggcacttcctcgacatggtcgccggcctgcccacgctgcgcgcgttcggccgggcccggggccaggtcgaggtggtccgccggatggccgacgggcaccgcgccgcgacgatgcgcacgctgcggatcgcgttcctgtccgcgctggtgctggagctggtcgccaccctgtcggtggcgctggtcgcggtgccggtgggcatccggctgctcggcggcgggctggcgctgtccaccgcgctgctggtgctgctgctcaccccggaggcgtacctgccgctgcgggcggccggcagccggttccacgccagcatggaggggctggccgcgctggacgaggcactgaccctctccgccgccgacccgaccgccacggccaccgccgggtcgcggcccgtccccgacgggcgcgccgagatccggttcgagggcgtgaccgtcgcgtacgagcggaccgtggcgctacgggacgtcacgctgacaatccggcccggcgagcggatcgcgatcgtcgggccgagcggcgcgggcaagagcaccctgctcaacctgctgctcggcttcgtcgccccgacgcagggccgggtcaccgtgggtggcgtcgacctggccggcgcggacccggacggctggcggcgtcaggtcgcctgggtgccgcaacgggcccacctcttcgccgcctcgctgaccgacaacatccggctcggtgcccccggcacgcccgacgccgcgctcgccggcgcggtcgccgccgccgcgctggacgaggtggtcgccgccctgcccgacgggctcgacaccgtgctcggtgagcgcgggcacggcctgtccagcggccagcggcagcgggtcgccctggcccgggcgttcctgcgggacgcgccggtggtgctgctggacgagccgaccgcgcggctggacaccgccagcgaggccggggtgctggccgccacccgccggctcgtcgccgggcgaaccgccctgttggtggcccaccggccggcgctgctctccgacgccgaccggatcctgcgggtcgaggaaggccgggtcaccgagctgaccaccaccccggccacaggggtgacccccggccccggcgaggcggctgccggaccggccgggcaggtcgcccccgccccggccggagagggggcggcccga

SEQ ID NO: 149 - protein, 561 aa, Micromonospora carbonacea
  evcD
VLAVLGGLTALLVVGQATALATVLAAALDGRLARPALAGFLAAVVGRALVAWAQGTVAARAAATVKAALRADLLAAVGRHGPGWVAGQRAGQLATLAGRGLDALDAYFTGYLPQLVLSVTVPVAVLARITFADWGSAVIVALTLPLIPVFGALLGWQAQAATERQWRRLSTLGGHFLDMVAGLPTLRAFGRARGQVEVVRRMADGHRAATMRTLRIAFLSALVLELVATLSVALVAVPVGIRLLGGGLALSTALLVLLLTPEAYLPLRAAGSRFHASMEGLAALDEALTLSAADPTATATAGSRPVPDGRAEIRFEGVTVAYERTVALRDVTLTIRPGERIAIVGPSGAGKSTLLNLLLGFVAPTQGRVTVGGVDLAGADPDGWRRQVAWVPQRAHLFAASLTDNIRLGAPGTPDAALAGAVAAAALDEVVAALPDGLDTVLGERGHGLSSGQRQRVALARAFLRDAPVVLLDEPTARLDTASEAGVLAATRRLVAGRTALLVAHRPALLSDADRILRVEEGRVTELTTTPATGVTPGPGEAAAGPAGQVAPAPAGEGAAR

SEQ ID NO: 150 - DNA, 1839 bp, Micromonospora carbonacea
  CDS (1)..(1839): evcE
atgagcaccggtcccgccgacgacgccttcgccatcccgctgccggccgacggggccccggtggccggcggcagcgtccgggccgccgagcgggccgtgctccggctggcccggccgtacctgggccggctggtcggcgcgggtctgctcgccgccgccaccgagttcgccgggctggccctgatggccaccgccacctggctgctgatgagcgccgccggtcggccaccactggaccggctcaccgtggcgatcgtcgcggtccgggcgctggcgatcagccgaggcgtgttccgctacaccgagcgcctcgccggccacgatgccgtgctgcggatgatcaccgacgtccgggccggggtcttcgccgccctggccgcccggcgcgacgccgcccggcagcgcaccggggacgcgctgagccggctcgtgtccgacgtggaggccgtgcaggacctgctgctgcgggtgctcgtcccgggggccgccgccacggtggtcagcgtgctggccgtggccggggccaccaccatctcgctccccgccgccggggtgctggcgctgggcctgctcgtcgccggggtggccctgccgctcgcggccaccgcgctgacccggcacgccgccgaccgggtggccccgctgcgcggcgcgctcgccacggacgccgtggaccttgtccacggcgccgccgacctggccgcgttcggtgccaccgggtacgcgctggacgccgccgccgatcgggcccgccggctggcccggctggaacgacggctcgccgccaccggcttcgccgtggacgccgccggggcgctcgtcgccggggtgaccgccggcacggtggtggtcaccgcgctgcgcgacggcgtcggcggggtgctggtcggggtgctggcggtcggttccctggccgccgtcgaggtggcgctggcgctggtcggggccgcccggcagcgcacccagctccgggccgggctggtccgggtggccgccctgctgaccgccccgcaggccgacgcgcccgccgccaccccgcccggtgccgcccgtgccgccgccgtcggtgccggcccgcacgacgtgcgcttcgacgcggtcaccgtgcggtaccgggccggcaccgccccggccctggaccgggtcaccctggacctgccggccggccgccgggtcgccgtggtcgggccgagcggcgccggcaagagcaccctcgccgccgtcctcaccggcacggtgcgacccgagcagggccgggtcaccctcgacggggccgacctgtcggcgtacccggtcgaggaactgccccgggccgtcggcggcctgctcgccgaggcgtacgtcttccacgccacggtccgggagaacctgctgctcggccggcccgccgccgacgaggcggagctgaccgccgcgacccgggcggccggcctgctggactgggtgcacgcccagccggccgggtgggacaccgtggtcggcgaggagggcggacagctctccggcggccagcggcagcgcctcgcgctggcccgggcgctgctcgccgcgcccggggtgctggtgctcgacgagccgaccgaggggctcgacccgtccgccgccgacgcggtgctcgcctcggcgctggcggcgacccccgccgggcactcggtgctgctgatcagccaccggctcagcgggctcgccgacctcgacgagatcgtggtgctcgacgccggccgggtggtccagcgtggccggcacgacgagttggtcgccgcgccgggctggtaccgggaccagtggctgctccaggaggcggccgagcgcgggtacctggccctgacgccccgcccc

SEQ ID NO: 151 - protein, 613 aa, Micromonospora carbonacea
  evcE
MSTGPADDAFAIPLPADGAPVAGGSVRAAERAVLRLARPYLGRLVGAGLLAAATEFAGLALMATATWLLMSAAGRPPLDRLTVAIVAVRALAISRGVFRYTERLAGHDAVLRMITDVRAGVFAALAARRDAARQRTGDALSRLVSDVEAVQDLLLRVLVPGAAATVVSVLAVAGATTISLPAAGVLALGLLVAGVALPLAATALTRHAADRVAPLRGALATDAVDLVHGAADLAAFGATGYALDAAADRARRLARLERRLAATGFAVDAAGALVAGVTAGTVVVTALRDGVGGVLVGVLAVGSLAAVEVALALVGAARQRTQLRAGLVRVAALLTAPQADAPAATPPGAARAAAVGAGPHDVRFDAVTVRYRAGTAPALDRVTLDLPAGRRVAVVGPSGAGKSTLAAVLTGTVRPEQGRVTLDGADLSAYPVEELPRAVGGLLAEAYVFHATVRENLLLGRPAADEAELTAATRAAGLLDWVHAQPAGWDTVVGEEGGQLSGGQRQRLALARALLAAPGVLVLDEPTEGLDPSAADAVLASALAATPAGHSVLLISHRLSGLADLDEIVVLDAGRVVQRGRHDELVAAPGWYRDQWLLQEAAERGYLALTPRP

SEQ ID NO: 152 - DNA, 687 bp, Micromonospora carbonacea
  CDS (1)..(687): evcF
atggtgcgctgcgacgacgtactcgtgaaggagcggctgcgcgagttgagcgaccggctgcacggcccggcacggctcaaggccgacctgctggccgaggcccgccacgcgttgcaggacgccgtcgaggcgtaccgggacggcgggctgccggcggcggaggccgagcggcgggcagtggccgagttcggcgagccggcccggctcgccccggcgtaccaggcggagctggcggccgggtcgctgcgcggcctgtccctgcgggtgctcgcggtcgccggcgtcctggtcgtcgcgggcgatctgacctggcaggggtcgagctggagcggcggccccggcccgccggcggcctaccgcctgctgtccgcctcggtggacggcatctggctgggcgcggtcgtgctgtcggtggcggggttgctgctggtcgccgcctcggcccggtgggcgcacccggccctgccccggctcgcccggctgaccggtctcgggctcaccgccacgctcgtcctgggcgtggcgaccggcgcggccctgtacgcctggtcgatcgggctctgggaggcggcccgcacctggccgccgatgctcgtgggcgcgctggtctgcggcgcggggttcttctggatcggtcgggcggcccggtcctggctgctctcggcacgccgaccggccggaccggcg

SEQ ID NO: 153 - protein, 229 aa, Micromonospora carbonacea
  evcF
MVRCDDVLVKERLRELSDRLHGPARLKADLLAEARHALQDAVEAYRDGGLPAAEAERRAVAEFGEPARLAPAYQAELAAGSLRGLSLRVLAVAGVLVVAGDLTWQGSSWSGGPGPPAAYRLLSASVDGIWLGAVVLSVAGLLLVAASARWAHPALPRLARLTGLGLTATLVLGVATGAALYAWSIGLWEAARTWPPMLVGALVCGAGFFWIGRAARSWLLSARRPAGPA

SEQ ID NO: 154 - DNA, 333 bp, Micromonospora carbonacea
  CDS (1)..(333): evcG
atgaaggcccaggcgctgcacggacacctcgacgcgctgctgctcgcggtgctggaacggggcgcgctgcacggctacgccatcatcgaggcgctgcgcgcgcgcagcgagggcagcctcgatctgcctaccgggacgatctacccggcgctgcgccggctggagcgggcggggcacgtggtcagcagttggagcaccgtcaacggccgcgagcgccgcacctacgagctgaccgactccggccgccgggccctcgccggggaacgggccggctggcgggagttcagcgcgaccgtcggccagttcctcggcgacacccccgccacgccggcc

SEQ ID NO: 155 - protein, 111 aa, Micromonospora carbonacea
  evcG
MKAQALHGHLDALLLAVLERGALHGYAIIEALRARSEGSLDLPTGTIYPALRRLERAGHVVSSWSTVNGRERRTYELTDSGRRALAGERAGWREFSATVGQFLGDTPATPA

SEQ ID NO: 156 - DNA, 909 bp, Micromonospora carbonacea
  CDS (1)..(909): evcH
gtgggcagcccgaagcacacggaggtcagcgtggcccgccagtcgccccaacggcccgacgccgacgagcctgagctcgacgagaccgacggcaccgccgcagaggtcgaagaggacggcgcgcgcccgtcggcgcaggacgccgaccgcgcgctctgggacgagctgcgcatcgacccggtcgagatcgccctgcccgccggcaccggctacacgctgcgggcgtaccggccggcacgggagttgaccccgaccgacgtcgccgagcgcgaccaggacgacccgttcctggcccgccggcaggcggtcgagaccgacgaggacgaggacgaggtcatcatcctcgacgaggaggtggccgccgagttcgccgaggcggacgcggaggaggccggcgggaagtcccgctcccgcaagccccgcgccgacgcggactccgacgacgccggagccgccacagacgcggacgcggaggaggagccggactccgacgaggacgaggcgggcgacgaggaggttccggtcttcctcagccaccggggcaggctgctgctgttcaagacgcccgaatccctcgtcagcttcgtccggtccggcgcacccaacgacatgtctcaactggacagctggaatgaactgtccgaacgggtggagccggccgacatcgtcccgctcgacgaggacacctacgagctggacctggtcgtggagaacctgcggggtgggcacgacacctgggactcggcgctgctgatcgagccggcgaggtggcccgggacgtcgcgtatgccctgcgtctgcccgccgtgttggacatgctctccgccggctccagcctcgacgacctggacgaggcgctgcgcgccacggccaacggcgggctcgggggcttcctcggccgccggcggc

SEQ ID NO: 157 - protein, 303 aa, Micromonospora carbonacea
  evcH
VGSPKHTEVSVARQSPQRPDADEPELDETDGTAAEVEEDGARPSAQDADRALWDELRIDPVEIALPAGTGYTLRAYRPARELTPTDVAERDQDDPFLARRQAVETDEDEDEVIILDEEVAAEFAEADAEEAGGKSRSRKPRADADSDDAGAATDADAEEEPDSDEDEAGDEEVPVFLSHRGRLLLFKTPESLVSFVRSGAPNDMSQLDSWNELSERVEPADIVPLDEDTYELDLVVENLRGGHDTWDSALLIEPARWPGTSRMPCVCPPCWTCSPPAPASTTWTRRCAPRPTAGSGASSAAGG

SEQ ID NO: 158 - DNA, 2073 bp, Micromonospora carbonacea
  CDS (1)..(2073): evcI
atgcagtccgcgccggccgagcggcgggcggtcgggctggcccgggcgctccaggccggcgcgctctcggcggtcaccctcccggcgccccgggatctcgccggctacaagcaggtcctctcggcgcacgccgcgctcgccagcggccggcactccgccgccgtggcgctgcgcgaggtgctgcgggagctctacccggccgccctgcgcgcgtacccggacccggccgagccggtcgccctggccgtgttggacgccctgcccgagcccggcatgctgggcgggacgatcgcccggggccgggaggtgtcggtggcggcggacgccatcgccgcccacctcgcggccgacggggtggccgacgaaggcaagatcaacgatgcggtgaccgcgctgcgggtcgccatcgccgagaccccccgccgcgcggcggtcagccgggcgctcacctccgccgtggcggagacggtccgtcaggcggtggcctcggtgcgagcatgcgacgcgggctgcgaggccctggtcggcgcgctcgacgcccgggtcaccacccccaccccggtgccgggccggcgggccgccgcccgccggggcgagccggtcgccgagttgcccggcgccggcctgcgcgcactgcggcccacagagcccgagccggtccccggccggcgcagccgtcccgagccggtccccggcggcagcctgcccgcccagccccgcccgctcggcccgccgccggtcgcgccggagcccgtcgccccgccgccggtcgccccgcgcccgatcaccccggccgcctcggccaccccgccggtctccggcccgccgtcgcccgagccgcgccgcctgatcgacaacccggccaaccggccggtctccgcgccgccgcccccgccaccggggatcaccccgatcgcgccgagccagcgcgagcgcgggtccgtgccgccggccgaggccggtgagccgttccggcccacgctgaccaccgccgcgatccagaacgcgcgggcggagcggcagcgcaccatcatcccgcctcgccccaagacgacgggcgagtccgcgccgccgcccaccggcggcttcagcgccaccgacctgagcgtcccggtgccgaccccgcgtcccggccaggagtccgctccccccggctcgcgggcgaactggccgctggtcaacaaccccgaggaccccgccgacagctccccgaacaatcccgtcgcgcggcggcccttggaggatcgggcgaagcggcagatcgacgcgccgacccaggtggtcccgccggccgagggccgggtcaccccgccctggctcgccgacgacctgccccaggagccaccgatgctgcggctggtcgagccgccaccgctggccgaccgggcactgcgggatgggccgggccaggctgccgacccgcgcctggagcccccgccgctgcggctggtcgaccgcggcgaggcagcccgcgccggccgtcccgcgccggagccccgccccgagcgggcccccgcggaacaccggtccccgctgggtcagcgggtcccgttggaggagcggcccgacatggaacatcggaccgccccgccgcagccgtcgcggtccgcgccgatggagcggcgtaccccgccgatctccgacgagggggacggcgacctgctgatcttcgccgccgccaagtcggcctggttcgtcgggcacggcgacgagtccgagatggactggtcgagcaccgccgacaccgggtggcaggccgccgagcaggccgcccgcccggcggtgggcgccgataccaaggccgggttgcccaagcgggtgccgcaggccaacctggttccgggctcccccctgcgcgaggagcgtcccctacggatagtccgcgacgcggccagcctcgccgagaacacgaccggctacttccggggctggcgtcgcgggcaggagatcggcgggttcgccgtcggcggccggccgggccgcgaggcggccggcggctgggacttcacccgggacaccggcgaccgagacgacgaccgggagtacgagtaccggtccgccggctaccgctcc

SEQ ID NO: 159 - protein, 691 aa, Micromonospora carbonacea
  evcI
MQSAPAERRAVGLARALQAGALSAVTLPAPRDLAGYKQVLSAHAALASGRHSAAVALREVLRELYPAALRAYPDPAEPVALAVLDALPEPGMLGGTIARGREVSVAADAIAAHLAADGVADEGKINDAVTALRVAIAETPRRAAVSRALTSAVAETVRQAVASVRACDAGCEALVGALDARVTTPTPVPGRRAAARRGEPVAELPGAGLRALRPTEPEPVPGRRSRPEPVPGGSLPAQPRPLGPPPVAPEPVAPPPVAPRPITPAASATPPVSGPPSPEPRRLIDNPANRPVSAPPPPPPGITPIAPSQRERGSVPPAEAGEPFRPTLTTAAIQNARAERQRTIIPPRPKTTGESAPPPTGGFSATDLSVPVPTPRPGQESAPPGSRANWPLVNNPEDPADSSPNNPVARRPLEDRAKRQIDAPTQVVPPAEGRVTPPWLADDLPQEPPMLRLVEPPPLADRALRDGPGQAADPRLEPPPLRLVDRGEAARAGRPAPEPRPERAPAEHRSPLGQRVPLEERPDMEHRTAPPQPSRSAPMERRTPPISDEGDGDLLIFAAAKSAWFVGHGDESEMDWSSTADTGWQAAEQAARPAVGADTKAGLPKRVPQANLVPGSPLREERPLRIVRDAASLAENTTGYFRGWRRGQEIGGFAVGGRPGREAAGGWDFTRDTGDRDDDREYEYRSAGYRS

SEQ ID NO: 160 - DNA, 591 bp, Micromonospora carbonacea
  CDS (1)..(591): evcJ
atgtcgcaccgcccgcctgtcccgagcgggcgcgtgacgtcggcgaagatcgttatcgccggtgggttcggcgtcggcaagacgacgctggtcggctcggtctcggagatcacgccgctgaccaccgaggcgatcatgacctccgccggcgtgggcgtcgacgacacccggcaggtgccgggcgagacgacgaccacggtggcgatggacttcggccgtatctcgatcgaccgggacctgatcctgtacctgttcggcacccccggccagacccggttctggttcatgtgggacgagctggtccggggcgccatcggcgcggtggtcctggtcgacacccggcggctggccgactgcttcgcggccatcgacttcttcgagcatcggcggctgccgtacctggtggccatcaactgcttcgacgggatgcagtaccacgacccgcaggacgtccgggacgcgctcgcgatctcgcacgacgtgccggtggtggcctgcgacgcccggaaccgggagtcgacgaagcacgtgctgatctcgctggtcgagtacgtgctcacgatgcgccgctcgcgcgcggtcgcgccggcc

SEQ ID NO: 161 - protein, 197 aa, Micromonospora carbonacea
  evcJ
MSHRPPVPSGRVTSAKIVIAGGFGVGKTTLVGSVSEITPLTTEAIMTSAGVGVDDTRQVPGETTTTVAMDFGRISIDRDLILYLFGTPGQTRFWFMWDELVRGAIGAVVLVDTRRLADCFAAIDFFEHRRLPYLVAINCFDGMQYHDPQDVRDALAISHDVPVVACDARNRESTKHVLISLVEYVLTMRRSRAVAPA

SEQ ID NO: 162 - DNA, 402 bp, Micromonospora carbonacea
  CDS (1)..(402): evcJ2
gtgtcggggacgaaggaggtgagcggcgacatggatcgtgacgagccgactggcgcgttggtccgtccgtacgccgtcacccgcggtcgtacccgccctcggctggacatcgcgttggaggcgctcgtcgagacgacggtgcgcggtcgggccgctgccagtagcaacggtggccagggccgagagcaccagtacatcgccgcgctgtgcgacggacgcgtgcagtcgcttgccgagatcgcggcgcggatgcagctcccgctcggcgtggctagggtgctcatcgccgacatggcgacggacggcctggtcgcagtccacgagccgaccatcctggacgactccgacgacgcggtgggcactgaactgctggagagggtgctgagtggacttcgcaggctc

SEQ ID NO: 163 - protein, 134 aa, Micromonospora carbonacea
  evcJ2
VSGTKEVSGDMDRDEPTGALVRPYAVTRGRTRPRLDIALEALVETTVRGRAAASSNGGQGREHQYIAALCDGRVQSLAEIAARMQLPLGVARVLIADMATDGLVAVHEPTILDDSDDAVGTELLERVLSGLRRL

SEQ ID NO: 164 - DNA, 351 bp, Micromonospora carbonacea
  CDS (1)..(351): evcK
gtgcccggtgtcgcgcacgcggtcgccgtctccgcggacggtctgctcctggcgtcgtcacgagaccttccgcgtgaccgggccgaccagctcgccgcgatcgcgtccgggctggtcagcctcacgcagggagcggcacgctgcttcgagggcggtgcggtgctgcagaccgtggtcgagatggacaacggcttcctgttcctgatgtccatctcggacggctcgtccttcgccgtgctcgccgcccgtagctgcgacgtcgggcaggtcggatacgagatggccctcctggtcgaccgggtgggcgacgcgttgaccccgcagccgcgtacgactgtggggatgatgggc

SEQ ID NO: 165 - protein, 117 aa, Micromonospora carbonacea
  evcK
VPGVAHAVAVSADGLLLASSRDLPRDRADQLAAIASGLVSLTQGAARCFEGGAVLQTVVEMDNGFLFLMSISDGSSFAVLAARSCDVGQVGYEMALLVDRVGDALTPQPRTTVGMMG

SEQ ID NO: 166 - DNA, 3435 bp, Micromonospora carbonacea
  CDS (1)..(3435): evcL
atgccgatctggtccaagctcggtctcatcatgatcgtgccgaccatcgccacggtcgtcgtcggcaccagtggcctcgtcgacaacctggaaacgctgaacaacgccaaccgctccggcgacctggccaatctggtgggctactcgggcgacctggtcaacagcctccaggacgaacgcacctccgcggtgttgctgctcggggcgagcggcgaccaggccaaggcgcagtaccaggaggcgtacaaccgggtcaacatccgggtcgaccaggacaaggtgccgtacctgcaacagcggggggaggtcgacggcctgccgagcagcctggagggcctcctcgacgggatcgaccagaacctgaaggacctccccggcacccgcagccaggtcttcaacggcaagttgaagatcatcgacgccatgcaggcgtacgagggcctgatcaacgacctgctgtccatccgcgactccgccacccacctcgccggtgacaacgacctgagcgaccggatgcgggccgcggcagccgtcgcccgggagaaggaatacctctcggtccgccgggtcgtggtgcaccgggcgctgatccagcgcgagttgacccccatcctgcgcaccgactacatcgccagcggcaccggccagcagcaggcactgcaaagcttcaaggcggtggccagcctggacgagtcggacctgcacgaccagaccgtcgccggcggcgaccggcgcgaggcgcagaactacaccggctggctcgacggcaacaccaacggcagcatggccaacgcgccgttcgggccggatcagtgggacgcggccatggtcgccagcgccaaactgatccgtacggtcgaggcgaagctcgacggcaacgtggtcaagcaggccgacgcgctccgctccgacgtacagcgcacggtgttcctccagaccggcctgctgctcggcatgctgctgctggccatcctgttcgcgtacctggtcgcccggtcgatggcccgctcgctgcgcgacctgcgccagggtgcgctcagcatcgcccagtacggtttgccccaggccgttgcccggctgcgcgatccgcagttttccagccagctctccccggtgcaggcggccaaccagatcgccgagccgctgccggtgcgcagcaaggacgagttcggccaggtgaccgaggcgttcaacgcggtccacctggaggccgtacggacggcggcggagcaggccgcgctgcgcgcctccgtcgcgaccatgttcgtcaacctggcccgccgttcgcagatcctggtcgaccggctgatcggccacctcgaccggctggagcgcggcgaggaggacccggaccggctggccgagctgttccagctcgaccacctggccacccggatgcgccgcaacgacgagaacctgctggtgctcgccggggccgactccacccgcgtgcagcgcgagccggcggcactgatcgacgtgctgcgggccgcccagtccgaggtcgagcactacacccggatcgagttcggggtgatcgaccgtgacatcgaggtcgccgcgcacgcggtcaacgacctggtccacctggtcgccgagctgttcgacaacgcgaccgccttctcgccgcccgactcgcaggtgatggtggaggcccgccgggtcggcgaccgggccaacctctacgtcgaggaccggggcatcggcatcagcgccgagcagctacacgacctcaacgaccgcctcgcctcgccgccgcaggtggacgtggccgtctcccggatgatgggcctggttgtggtcgcccggttggcgtcccggcacggggtcaaggtcgagctgcggcccggcaccgaccgggggaccgtcgccgacgtcaccctgcccaccaccgtgctggtgccccgggcgctctccggccggttccagcagcccggcgcgctgccggcccctcccgcctcgctcaccagctcgcagcccggcggggcccccccggccctgggtgccttcgcggccttcggcaacaacccggcgacaccggcgcccacccagcggccggggcactcgggcaaccaggtaaccctgggcggccggtcgttcgacccggcctcgcgcaacggccacggcacgcccgcgtcgaccggttccatgcggtcgatgccggcctggtcggacctgaccggggccagtggcaccgctggcggtgccgccgccggccgcacctcgaatggccagtcgagcgacccgctgccgcagcggcgggcgtccggcgacggcgatccggccagcagcggccagcagccggccatcccccgacagctgccgagcagcccggaggcccggggctggaccccgccaccggtctcggtgccgccggtgtccgcaccgccggtttccgtcttcccggtctcgggtcagcccgtctcggccgccccggtgtccggtcagccgttcggcacgcccgtctccggtcagccgttcggcacgcccgtgtccggtcagccgtactcggcgcagccgctgcccagtcggccggtcccgtcggcccaggcgcccgtggcgccgccggcctggccgccggtggccgcgccggagccggtcaccccgccggtgccggagcgcctcgccgcagccctggacatgaccacggagctgccccgggtgccgagcaccgaggtgccgagcacgccggccacccagccgacgaccccgcccacgccggcgcggtcgacgcccgtgcaggcccagaaccggcagcagcggtacgcggacgagacgatggagctgccgatcttccgggagctcgagtcggcctggttccgtacccgccgctcgggttcggaggagacggccggcgtcgcccagcgcgcgaccaatggcgccgggagcccggcgaacgccgccgtgacccaacagttctccgcggtcgacgtcaccggccggcccgtccagacaccagcacccgggacgacaggtaacgcaccgatggcagacaccccgatggccggaggaatgccgcgcgacaacgggtcgccgaccaacggtggcacccgccccggtcccgccgagggcttcgccggccggcggcccacgccgcaggcccacgcctggcagactgccgcggacgacggctggcgggccgcctcggcggccaccgaggtcccggtggcggagaccacccgcaagggcctgccgaagcgggtgccgatggcccaactcgtgcctggcggggtggagaagcccaccacgtcggtccagcgccgtacgccggagggcgtccgcggtctgctctcggcataccatcgaggcgtgcagcgtgggcgtaccgagcccgacggcaacccgaccaacccggaggcagctccgggtgggcagcaatcctcgcagtctggctcaggcccggtggccgggagcgggcagaaggagcaacaagga

SEQ ID NO: 167 - protein, 1145 aa, Micromonospora carbonacea
  evcL
MPIWSKLGLIMIVPTIATVVVGTSGLVDNLETLNNANRSGDLANLVGYSGDLVNSLQDERTSAVLLLGASGDQAKAQYQEAYNRVNIRVDQDKVPYLQQRGEVDGLPSSLEGLLDGIDQNLKDLPGTRSQVFNGKLKIIDAMQAYEGLINDLLSIRDSATHLAGDNDLSDRMRAAAAVAREKEYLSVRRVVVHRALIQRELTPILRTDYIASGTGQQQALQSFKAVASLDESDLHDQTVAGGDRREAQNYTGWLDGNTNGSMANAPFGPDQWDAAMVASAKLIRTVEAKLDGNVVKQADALRSDVQRTVFLQTGLLLGMLLLAILFAYLVARSMARSLRDLRQGALSIAQYGLPQAVARLRDPQFSSQLSPVQAANQIAEPLPVRSKDEFGQVTEAFNAVHLEAVRTAAEQAALRASVATMFVNLARRSQILVDRLIGHLDRLERGEEDPDRLAELFQLDHLATRMRRNDENLLVLAGADSTRVQREPAALIDVLRAAQSEVEHYTRIEFGVIDRDIEVAAHAVNDLVHLVAELFDNATAFSPPDSQVMVEARRVGDRANLYVEDRGIGISAEQLHDLNDRLASPPQVDVAVSRMMGLVVVARLASRHGVKVELRPGTDRGTVADVTLPTTVLVPRALSGRFQQPGALPAPPASLTSSQPGGAPPALGAFAAFGNNPATPAPTQRPGHSGNQVTLGGRSFDPASRNGHGTPASTGSMRSMPAWSDLTGASGTAGGAAAGRTSNGQSSDPLPQRRASGDGDPASSGQQPAIPRQLPSSPEARGWTPPPVSVPPVSAPPVSVFPVSGQPVSAAPVSGQPFGTPVSGQPFGTPVSGQPYSAQPLPSRPVPSAQAPVAPPAWPPVAAPEPVTPPVPERLAAALDMTTELPRVPSTEVPSTPATQPTTPPTPARSTPVQAQNRQQRYADETMELPIFRELESAWFRTRRSGSEETAGVAQRATNGAGSPANAAVTQQFSAVDVTGRPVQTPAPGTTGNAPMADTPMAGGMPRDNGSPTNGGTRPGPAEGFAGRRPTPQAHAWQTAADDGWRAASAATEVPVAETTRKGLPKRVPMAQLVPGGVEKPTTSVQRRTPEGVRGLLSAYHRGVQRGRTEPDGNPTNPEAAPGGQQSSQSGSGPVAGSGQKEQQG

SEQ ID NO: 168 - DNA, 603 bp, Micromonospora carbonacea
  CDS (1)..(603): evcM
atggatcacccccaccgcctcgtcctgctcgccggcccttcgggctccggaaagtcgtacatagcccaacaaaccgggcttcctgttctttgtctggacgacttctacaaggatggtgatgaccctacgttaccgcgccaaaacggtcttgtggactgggactcaccccagtcgtgggacgccggggcggccgtggaaacgattgcccggctggcgcgggacggcaaggccgaagtgccggtttatgcgatcggcgcggaccggcgggtggccacccggacattcgaggtcgccggatcgccacttttcgtcgccgaagggattttcgccgccgagatcgtcgaggaatgccgacggcgagggctgctcgccggggcgtacgcgctgcgccggccgcgcggcaccacctttttccggcggctcgcccgcgacctggccgagcagcgcaaggctcccgggatgctgctgcggcgcggcctggccctgctgcgcgcggagccggcggtgctgcgccgccaggcggggctcggcgctcacccggccccggcccgcgaggtgctgcgccgggtggccgacctgctcgccggccacccgcaccacccc

SEQ ID NO: 169 - protein, 201 aa, Micromonospora carbonacea
  evcM
MDHPHRLVLLAGPSGSGKSYIAQQTGLPVLCLDDFYKDGDDPTLPRQNGLVDWDSPQSWDAGAAVETIARLARDGKAEVPVYAIGADRRVATRTFEVAGSPLFVAEGIFAAEIVEECRRRGLLAGAYALRRPRGTTFFRRLARDLAEQRKAPGMLLRRGLALLRAEPAVLRRQAGLGAHPAPAREVLRRVADLLAGHPHHP

SEQ ID NO: 170 - DNA, 1074 bp, Micromonospora carbonacea
  CDS (1)..(1074): evcN
atggtcgcaatctcatacgaggacatcgtcaaggtccccaaggcgctgctgcacgaccacctcgacggcggcctgcggccggcgacgatcgtcgagctggccgccgaggtcggccacgagctgcccaccaccgacccggaagcgctcggccgctggttcgtcgcggcggcgaactccggctcgctggagcgctacctggagacgttcgcccacaccgtggcggtcatgcagaccgcgcccgcactgcggcgggtggcccaggagtgcgcgctggacctggccgccgacggggtcgtctacgccgaggtgcggttcgcccccgagcagcacctggagcgggacctgaccctggacgaggtggtcgaggcggtcgtcgccgggttcgccgagggcgcggcgctcgccgccgacgccggccatccgatccgggtcggcaccctgctcaccgccatgcggcacgccgcccggtcgcaggagatcgccgaactggcggtgcggcaccgcgacgccggcgtggtgggcttcgacatcgccggggcggaggcgggattcccgcccacccggcacctggacgccttcgagtacctgcagcgggagaacttccacttcaccattcacgccggcgaggcgttcgggctgccgtcgatctggcaggccatccagtggtgcggcgcggaccgcctcggccacggggtgcgcatcgtggacgacatcacccccggcgacccgcccgtgctgggccggctggccgcgtacgtgcgggacaagcggatcccgctggagctgtgcccgtcgtcgaacgtgcagaccggcgcggcggcgtcgatcgccgagcacccgatcgggcttctgcgcgatctgcggttccgggtgacggtgaacaccgacaaccggctgatgagcggcacctcgatgtcccgggagatggcgctgctggcggaggccttcggctacggctggaaggagctccaatggttcaccatcaacgcgatgaagagcgcgttcatcccgttcgacgagcggctggccatcatcgacgaggtgatcaagccggcgtacgggaagctgctgggc

SEQ ID NO: 171 - protein, 358 aa, Micromonospora carbonacea
  evcN
MVAISYEDIVKVPKALLHDHLDGGLRPATIVELAAEVGHELPTTDPEALGRWFVAAANSGSLERYLETFAHTVAVMQTAPALRRVAQECALDLAADGVVYAEVRFAPEQHLERDLTLDEVVEAVVAGFAEGAALAADAGHPIRVGTLLTAMRHAARSQEIAELAVRHRDAGVVGFDIAGAEAGFPPTRHLDAFEYLQRENFHFTIHAGEAFGLPSIWQAIQWCGADRLGHGVRIVDDITPGDPPVLGRLAAYVRDKRIPLELCPSSNVQTGAAASIAEHPIGLLRDLRFRVTVNTDNRLMSGTSMSREMALLAEAFGYGWKELQWFTINAMKSAFIPFDERLAIIDEVIKPAYGKLLG

SEQ ID NO: 172 - DNA, 960 bp, Micromonospora carbonacea
  CDS (1)..(960): evrMR
atggacccccgcatcgtcgaccggctgcgttgcccggtctgcgcggaaccgctcaccgaggccgccgccgggaccacccgggcgctgcgctgcccgcgccggcacagcttcgacgtggcccgccaggggtacgtcgacctgctcgccggccgggccccgcacgtgggcgacaccgccgagatggtggccgcccgcgccgacttcctcgccgccgggcactacgacacgctctcggccgcgctcgccgccgccgcgctcgccgcgctgagccacccgccggaggcccccggagcggacgcgtcggccggcaaagacgggcaggatgcccaagccgggcgggatgcgtccgctggacatgacgcgtccgccggacagccggccgtcgggacgtacccgctggtggtggacgccggggcgggcacgggccggcacctcgccgcggtgctggcggcgctgcccgacgccgtgggcctggccctggacgtctccaagccggcgctgcgccgggcagcgcgggcccacccgcgcgcggcggcggcgctcgccgacacctggcggcggcttccgctggccgacgccagcgtcgccgtgctgctcgacgtcttcgccccgcgcaacggcgcggagttccgccgggtgctccacccggccggcgcgctgctcgtggtcacccccgccgaggaccacctcgccgaactggtcgactcgctcgacctgctgaaggtcgaccccgacaaggcggaccgggtcgccgggagcctggccggccacttcgagcagaccgccgagagcgtgctgcgggcccggctggaactcaccggccggcaggtggccaccctggtcgggatgggacccagcgcctggcacaccgacccggccaccctcgccgcccggatcgccgcgctacccgagccggtccgggtgaccctcgcggtacggctcggcgtgtaccgcccccgc

SEQ ID NO: 173 - protein, 320 aa, Micromonospora carbonacea
  evrMR
MDPRIVDRLRCPVCAEPLTEAAAGTTRALRCPRRHSFDVARQGYVDLLAGRAPHVGDTAEMVAARADFLAAGHYDTLSAALAAAALAALSHPPEAPGADASAGKDGQDAQAGRDASAGHDASAGQPAVGTYPLVVDAGAGTGRHLAAVLAALPDAVGLALDVSKPALRRAARAHPRAAAALADTWRRLPLADASVAVLLDVFAPRNGAEFRRVLHPAGALLVVTPAEDHLAELVDSLDLLKVDPDKADRVAGSLAGHFEQTAESVLRARLELTGRQVATLVGMGPSAWHTDPATLAARIAALPEPVRVTLAVRLGVYRPR

SEQ ID NO: 174 - DNA, 579 bp, Micromonospora carbonacea
  CDS (1)..(579): evrMR2
gtgtgggagccgggcgacgagatcgagctgcggccgaccgtcgagatcgaggcgcgcatcgccgtgctgcacgtgatcctggcccggtgtttcggcatgccggcgcaggcggcgatgagctggctgctcaactcccacctggtcgacctggtcaccccgccggagtggcagttcgtgatgggcggccggggcgaccaccggtcgttcgtgctgcaccacgacgcgctgttctcgctggcctgggtgctcggcctggccaagcagctcgacccgacgctgccggtcgacgagcggctggtggagcggctgccgcacatcgcgggcggggagagcttccagcagtggcgctcccgcatcctggccgcgccccagcacccggccgacgcggcggccctgctcgacctgcactactgcctcgactgggcgtacctggagctggagcgcgacgggcggtcgccgcccggcctggtcgacgccaacgcgatcgggcagcgccggtgggcgctggagtgggcggtggtcctgcgagggccctaccacgaggagccgccgggctgggaagaggtcgacctttccacc

SEQ ID NO: 175 - protein, 193 aa, Micromonospora carbonacea
  evrMR2
VWEPGDEIELRPTVEIEARIAVLHVILARCFGMPAQAAMSWLLNSHLVDLVTPPEWQFVMGGRGDHRSFVLHHDALFSLAWVLGLAKQLDPTLPVDERLVERLPHIAGGESFQQWRSRILAAPQHPADAAALLDLHYCLDWAYLELERDGRSPPGLVDANAIGQRRWALEWAVVLRGPYHEEPPGWEEVDLST

SEQ ID NO: 176 - DNA, 1176 bp, Micromonospora carbonacea
  CDS (1)..(1176)
gtgtggatcgagaagaacgggcccgtctaccgcattcgggacctcgttcgcggtaaaaaggtcaccattcagaccggttatccgacgaagaccagcgccaagaatgcgatggtgcagttccgtgcggagcagttgcagggcaacgcgctcatgccgcgcggcggtcagattaccctcgccgatttcgtgggggagtggtggccgagctacgaaaagacgctgaaaccgaccgccgtgaactcggagggcaaccggatccgcaaccacctcctgcccatactcggccatctcacccttgacgagctggacgggcaggtcacccagcagtgggtcaacgacctggaggccggcgtcggcccgtggccggagtccacgcggggtcgtcggaagccgctggcagcgaagacgatcagcaactgccacggcctgctgcacacgatctgcggcgcggcgatcgcggcgaaacggatcaggctcaacccgtgctcttcgacgatgctgccccggcgcgagccgaaagagatgaagttcctgagcgacccggagatcggtcggcttatcacggcgcttccgccgcactggcgaccgctcgtcatgctgctggtggcgaccggtctgaggtggggtgaggcgatcggcctgcgcgccggccgggtcgacctgctcgccgcgcggccccggctgaccgtcgtcgagcagctccaggagctggccagcacgggagagctcgtcttccagtcgccgaagaccgcgaagggccggcgcacggtcagtttcaccacgaaagtcgctctactgcttacgccactcatcgccggaaagaaaagtgacgaggtcgtgttcaccgcgccgaaaggcgggatggtaaggacgcgcaatttccggcggatctgggtcaaggcgtgcgaggaagccgggcttccgggcttacgcattcacgatctgcggcacactcacgcggcgatcctgatttctgccgggcgtccgctgtcggcgatctcccgccgcctcggtcactcgtcgatcgcggtcacggatctgctgtacgggcacctgcgtgaggaggtcgacgaggggatcctcgcggcgatcgaggaggcgatggccggcgtccgggctgaggacctggaggcggaactcgacgaggagctgacggacgtgttggccgacgcagca

SEQ ID NO: 177 - protein, 392 aa, Micromonospora carbonacea
VWIEKNGPVYRIRDLVRGKKVTIQTGYPTKTSAKNAMVQFRAEQLQGNALMPRGGQITLADFVGEWWPSYEKTLKPTAVNSEGNRIRNHLLPILGHLTLDELDGQVTQQWVNDLEAGVGPWPESTRGRRKPLAAKTISNCHGLLHTICGAAIAAKRIRLNPCSSTMLPRREPKEMKFLSDPEIGRLITALPPHWRPLVMLLVATGLRWGEAIGLRAGRVDLLAARPRLTVVEQLQELASTGELVFQSPKTAKGRRTVSFTTKVALLLTPLIAGKKSDEVVFTAPKGGMVRTRNFRRIWVKACEEAGLPGLRIHDLRHTHAAILISAGRPLSAISRRLGHSSIAVTDLLYGHLREEVDEGILAAIEEAMAGVRAEDLEAELDEELTDVLADAA

SEQ ID NO: 178 - DNA, 26 bp, Artificial Sequence
  Description of Artificial Sequence: Primer
ccctcgagatgtccagcaagatccta

SEQ ID NO: 179 - DNA, 24 bp, Artificial Sequence
  Description of Artificial Sequence: Primer
cgaattctcaggcagactgctctg

SEQ ID NO: 180 - DNA, 27 bp, Artificial Sequence
  Description of Artificial Sequence: Primer
ccctcgagaatgtccagcaagatccta

SEQ ID NO: 181 - DNA, 25 bp, Artificial Sequence
  Description of Artificial Sequence: Primer
cgaattcagactgctctgccgccgc

SEQ ID NO: 182 - DNA, 12152 bp, Micromonospora carbonacea
gtcttcggggaacgccacgggaacctcctcgccagaaccggacgagctgaccgtaaccggtgggcacccgcgcgcggatcaaccggtgcggtggttcccaggttccggccgcgcggccccgacgcaccgcccccggtgtgagaaggggacccatctctaccgtaggcgttaacaaggggcccttcctttcaccgcaggtgcaggacgtctcctgcggcgagggtgcgcgggcccgcccgggtgtcgaccagcagccggccgtcggcgtccacgccggtcgccacgccggtcacctccgcaccgccgggcagcagcacccgcaccggtctgccgaccgtcgcgcaggccgccaggtacgcgtcgcgcagcccgctggccaccgcgtcgccgccggcgtggcgccagcggtcgtaccagtcggcgacagagcgcagcagtgcgcgcagcagcgggtcccggtcggtggcgacggccccggcgagctggagcgaggtggccggcaggccggtcgggttcgccggcagctcgtcggcgcgcagggtgacgttgagaccgatgccgaggacgatcgccgggggctggtccggggccgggccgggcaccgcctcggccaggatgcccgcgcacttggcgtcgccgatcagcaggtcgttgggccacttgagggcggcgtccagctcggccagccgggccaccgcctcgaccagcgcgacgccggcgagcaggggcagccagccgtacccggtcgcgggggccggcggccagtcgcgctccgcgacagcctcgcccggccgcagcagcacgctggtcgcgattccggcgcggggcggcgactgccagacccggccgcgccggccccggccggcggtctgccgctcggcgatcaccacgaggccctccggctcgccggatcgggccgcctccgccacgtccgcgttggtcgagccggtctcggcgcgtagctccagccgggcccaggggccgtgcggggcggtcagcgcccggcgcagccgggccgccgacagcggcgggcgatccaggtcggtgtacggcgagccgggcatcccgccagcctacggcccgcccggacgcggcggcgggtgccggcgttgcccgagcccggtgaggttgctgaggcgtactgcacaccgtcggccacctgaaccatcgttatattccgtgggtgactaccgagaccgggatcaacatccacagcacggcgggcaagctggcggacctggagcgacgggtcgacgaggcggtgcacgccggatcggcgcgtgcggtgtccaagcagcacgcccggggcaagaagacggcgcgggagcggatcgggctgctgctcgacgaggggtccttcgtcgagctggacgggttcgcccggcaccggtccaccaacttcggcctggaccgcacccgcccgtacggcgacggggtgatcaccggctacggcacggtcgacgggcggcaggtctgcgtcttcgcgcaggacttcacggtcttcggcggctccctcggcgaggtgttcggcgaaaagatcgtcaaggtgatggacctggccatgaagatcggctgcccggtcgtcggcatcaacgactccggcggcgcccgcatccaggagggcgtggcgtccctcgggctctacggcgagatcttcttccgcaacgtgcgggccagcggcgtcatcccgcagatctccctgatcatgggcccgtgcgcgggcggcgcggtctattctccggcggtcaccgacttcaccgtgatggtcgaccagacctcgcacatgttcatcaccggccccgacgtgatcaagacggtcaccggcgaggacgtcgggatggaggaactgggcggtgcccgcacccacaacgcgcgcagcggcaacgcgcactacctcggcaccgacgaggaggacgcgatcgagtacgtcaaggcgctgctgtcgtacctgccgtcgaacaacctggacgagccgccggtcttcgacgccccggccgacgtggcgatcagcgacgccgaccgggagctggacagcctcgtcccggactcggcgaaccagccgtacgacatgcaccgggtcatcgagcacgtgctggacgacggggagttcctggaggtccagccgctgtacgcgcagaacatggtggtcggcttcggtcgaatcgagggacgaccggtcggcgtggtggccaaccagccgatgcacctcgccggcacgctggacatcgccgcgtcggagaaggccgcccggttcgtgcgcacctgcgacgcgttcaacatccccgtgctgaccttcgtggacgtgcccgggttcctacccggcaccggccaggagtgggacggcatcatccggcgcggcgcgaagctcatctacgcgtacgccgaggcgaccgtcccgaaggtcaccgtgatcacccgcaaggcgtacggcggggcgtacgacgtgatgggctccaagcacctgggcgcggatctgaacttcgcctggccgaccgcgcagatcgcggtgatgggcgcgcagggcgcggtgaacatcctgtaccggcaggagctggccgccgccgaggacccggccgccgtgcgcgccgagaagatcgccgagtacgaggacaccctggccaacccgtacgtcgccgccgagcgcgggtacgtcgactcggtgatcccgccgcacgagacgcgtacccagatcgtccgggcgttgcgggtgctgcgcaccaagcgcgagacgctcccggcgaagaagcacggcaacatcccgctctaggcgcggtgcagggaggggcccctgtcacgcgatccgtgcagcagggccccctcccgacgccggaggagccggcgggcccggcagccgggcgccggtcagcacgccgggttggcggcgaggcacatccgccgggcggccgtgcggcccagttcgagcagctccgcgtcgctggtctcgcgggggccgtccggcccgtcgacgcccaacccgcgctcgggcacgatgacggtgaccaggtcgccgacccggacgatcatccgggtttccggcgggtaccccacgtcgaggggcttgcccgtcgtggggtccaccggggacatcacggtgtgccgcaacacgaccgcctcgtcgccggcgaagtcgcgggcgatcgtctgccaggtgtgggccaccgagatcgcgccacggccgtcgtccaggggccgaaccgccgtgtcgctccagcgggcgcaggtggtcgccgcccggtccaggtcggcgagcagccggccggccggggcggggtcgaggcggtagacgtcctgggtgaggacggggacggccatcgacccgtcctggcccgacgtgtcgtccaggagcagcgtctgggatcgcgagtagcgagacaccggcggccccgcccccggctccttgcccacggcgcacgactggagcagcgggtccacccggacctgctcctgaagcccagagtcccccagtcgtacgttgctcggcacgcccaggtcggccgggtccagcagggcctcctggccgatctcggtccggccggaccgctccggctcggtagacgcgcgccacccgtcgacccaggacatcggcggcgcgaggtgcccgccggcccggccgccgaccgccacggcgaagaccgagagtacggccagcacggccgcggccgccgccatcgccgtacgccggctgcggcggcgggcccgggcgcggatgtccgccggctcgggccaacggacgtcccgcaggtcccggtgcatccgttcggcgaacgtcaggtcgtcacgcatcggcggcctcctccaggtcagagacggcgagcagcccggcgagcgcggcacgcccccgggagagacgggctttcacggtgccgaccggggcggcggtctcccgtgccacctcggccaccggcatgccgagcaggtagtgcagggcgatggcggtgcgctgcgcctcgggcagccggcgtagcgccgccaccacctccagcgtcgcggtgctcggcgcggggacgctctccggcgcaccgtgccgcaggtacgcccgcgcccggctacgcatgctgcgccaccggctcaccgcgatccggctcgccaccacgcgcagccagccctccggatcgtcgtacccgcgtacggtcggccagcgctgccatgcgcggatgtacgcctcctgcacggcgtcctgcgcctcggccaggtttccggtgatcatgtacacgaaacccagcaatcgttgccggctgccccggtagaactcgtcgaacccctcggcgtccggcatccgccacctccccgtgtcgcaggggacacgcctggcgggtggtccccggttgcccgaccggccggcttcttccctccccgggggtccccggcgggttcctcccggggtctcccggcgggcccgtcacgtcacggccggcgcggcgggctcgtcacgtcacggccggcgcggcgggccttcggcagcgaacagcgaccgtccgagaatcgggtgccggccggagtggtcgagggcgcgggtgggcggtggtcagaccgtgagcccggcgtcggtgaggatcgggccggcgagcagcagggcgccgacggcgaggccggccaggcagacgaccaggaagacaccgacccagaacaggggcgggaacggcgtcaaccgggcgagctggtcggcgtcggactccggcatccggccacggctgcgcagccgctgcaactcgatcaccggacgcacgccgccgaacagcaggaaccagaccgaggtccaggcgaacgcggcctgcacctgcggcggggcgtaccaggagacggcgaagaccagaccgccggtggcgagcagcgacagtgccccgtagacgttgcggatcatcgccagcatggccagcagcagcaccaccgtgaccgagagcagcatggtgatccggttcccggcgagcagccacgccccggccagcccgagcagggtcggggcgacgtacccggcgaacagggtgaggatcatgcccagcccggtggggcggccggccgacagggtgagcccggaggtgtccgagtgcagccggatgccgcgcagcttccgcccggtgagcagggcggccagcgcatgaccgccctcgtgggcgatggtcaccgcgttacgcgcgacccgccagggcacccgggtggcgaccaccgccagcgcgacggcggcggtggccaggaccagcagcggtggcgggtcgggttgcgcgccgacgagttcgttccagacgacgctcaggccgtcgatcaggtccacggggccgcagcctagcggccccggcccggttcgcgcgccgcgcgcccgccacggccgcggtgcccggcccgggcccggtcgaccagcgccggggcgcacgcccgccgctgaccggcacccggtcaggtcgcgggcaccccggtcaggtcgcctgcgacgaagaaggccgccgctctggtgcccacccgcaaccgccgccgagggcggacctcaccgaccggcggcaccttgcgtccacgtaggaccacggcgagcaccccggtcggcggcagcacggaagcgaccctggtcagcatcccgggcaggccctccccggcccgctccccctgccagctcgtctgctccccgtacggcaggtcggtcacgaccaggtcgggggtcatgcccgcgacggcctcggtgagggccacgcggtcgaacacgtcggcccgccgcaccgcgtacggcagcgggccgcctgccgcgtccagacgggcgcgcagccggtgggcggcggcggccgcctccgcgtagtgcggcttgtcgaacgcctcggcgcgttgcgccagctcgcgggcccgcgtgtcgagcccggcgccggtcagcaggccgaggttggcccgagcaaggtcgagggccgcctcgtcgacgtcggaggcgagcagcccggcaaggctcggccggtgcagcagcgcgagcaccgtcagcaggtagccgctgccgcagcacgggtcccagacggtggccggggcggacgtcgggcgcaactccagcgcggtttgcaggacctcggaggcgagccgcaccgggaacgccgggaagcccggcgccgagcgcaacacggcgccactggccaggtcgccgtacgcaccgcgtacggtttcgtgccggtaagtcacatgccctccccggcgcaccctaccaatccggcaccgccgggccgggtcaggcaggccgggactcgatccagtggaagtcggtgggaggcagcggcgtgacgtcctccagggacagccccgccttgccgcacagccgttccaggtcgcctcgggtccgctccaggccctgcccgttgaccagcatccccacgtcggtcaggtacgccagcgcgttggccgccgggccgaccacgtccggcagcacgtggtcgatcatgacgatccggccgcccggggcgaccgcctcggcacagtgccggaggattcccgtcgcccggccgtcgccccaaccgtggatcacacttttgagcaggtagaggtcggcgtcggcggggaccctctcgaagaagtcacccacctcgatccggcaccggtcgccgaccccggcgcggcgcaggttccccgccgcctccgcgctgccgctggcgctgtcgtagagcacgccccgcacgccggggttcgcggcgagcacggcggccagcagggtgccgtctccgccgcccacgtcgaccaccgtccgcacgccggccaggtcggtacgctcggcaacggccgccgcgacgctgtgggtcacctggctcatcgccgcgttgtacagctcggaaaggtcgggtcgcccgcccacgtagctgaagaagtcggtgccgaagatgccgtcgaaggccggctcgccggtgcggacgctgtgcgccaggccgtcccaggccgtggtcatggccgggtcggtcagcatccgggccagcgggcgcagcgtgccgggtcggtccccacgcagcagcgcccccatcggggcgagcgcgaaccggccgggtgtggtctcggtgagcacccgcagcgcggccagggcgcgcagcacccggaacatggtgtccgctcgggcgtcgtaccgcagcgccaactcctgcggggtgcgctcgtcgtcgccgatcgcgtcgggcagccccagccggacgcagtagccgaccagccggctggccatcccgccgaacaccaaccgcatcagctccggccaggcggcgtccgcgccggtctgcgcccggcgggcgctgggctcgtcggtcgtcgtggcccgctcgtccgtgtccgggacggtcatcggaccggctcggcggccggcaggcccagcccgatgcgcacggcccgttcgaccggcgagtagtcgccgtccgggcggtccaggtccagctcgcccaccggctgcaggctcggctgggccatgaaccggggccgcgtgccggtgttggccaccggggtgtgcaccaggaacgggtggcacaggtagacgtcaccggcgcgtccggtggcggaggcgagcgggcggtcccggccgacgtcgcccacgtcgaggtaggtgccctccgggccgtacggttcgagcagcggcggcacgtccaggtgggagccgaccctgaccagcgtcggcgcctcccgctcgtcggtgtcggagaagaggaacagcagcagcagggcccgcccccgcgaccggaggttgcagcggaagacctccgcgtagttgggcgggaccaggtccagctcgccctcccagttctgggggcccagccgctgcgcgtcgtcggccaggaaactggcgtcgatgtgccagccgtagtcctcggtctgctccgggcgcttgggcaccgggaaccggaccgggaaggtgccgatccggtccaacggcttccagcgccccaccccgacgagctggtcgaaggcggcgtgcagccggggcgtggtggcgctgcgcacgaagggctcggcgtcctggaggcccagccggaccacctcgcgggaccaggtgctccggtcctcggggtccatgccgagttgccgccacagcagttcgcgaccctgctgcgcgagctcggccgggaacgccgcctccaacttcacgaacccgtcggagacgaaccgctcgacctgctcgtcgctgaggacctgggcgctcatcgcactccttcccgccggttcccgccgaggcggagcgagacggtcgcacccgcgctgaccggaccgggcgacgcgcctcgtcaagattcgccaggttgaatggtagacaagccgccaccgtcagggactaacgttttcctcagcatcgtccgggccaccgcgagagcgccgcaccccccgctccaccacccgcaaccatcggctctccccgggtgcggcgatgccgtcgagccgggcgcgggcctcctccggcagcggccggtcggccgccgccagcgccgcccgggcctggtccagcgtgcgggggccgacgaccgtgctggtcacccccggcgcgtcgtagacccaggcgtgcgccaggtccggcagggacaggcccagctcgacggccaccttcgccaaccggcccagggtccgccacaccggctgccagtgcgggcccgatggggcgtaccaggcggtgaaccgggcgtcgcggggcggctcgccgtcggcgaaccggtcggagagcagacccatcgccagcgggctgtaggtgaacaggccgaggccgtactccgcgcacagcggcagcacgtcccgctcgatctcgcgttccagcaggttgtacggcgactgctcggccaccaccggggcggcgccccgggactgcgccgtgcgcagcaggtcgacgatccgccagctgggcaccgtgcccagccggggctggtcggccagctcgtatgccgtgggcacggtggaggtgcccacgtagcggaccttgcccgagcggaccaggtcgtcgagggcggacaccgtctcctccaccggagtgtccgggtcgtgacggtgcaggtagagcaggtcgatgtggtcggtacccagccggcgcaacgaccgctcgcactcccgcttcagggcgtacgccgaggtgccccggtcgttcggtcccgggccgaccggattgaagatcttggtggccagcaggacgtcgtcccggcagctccgcacggccgcgccgacgatctcctcgctgcggccgtcctggtagacgttggccgtgtcgacgaggttgactcccgcttcgacggccgtggcgacgatcctggcggcctcctccggcccggtcgggccgccgaagttgaacgcccccagggacaccttggacacccgcagtccacaccggcccaactgtcggtactccacgctgccctcccctgcggtggtggtcgccggccaccccgtcgtgcggccggtgctccccggagccggggagtggccgatctcgatgggggagcctagtaccgcgcgggtgcctcggccgtggtactagcagaactgctagagcatccgtcgagccgccgggcggccgggcggcagccggtacggtgtgcctgaacccaccacgggccggcgccggacgaccggtcgacgagcgatcgagctgatcggcggggagcggatgagcgacaagtacggccgcagtgcgctgtgggaacggtacaacagcacacaggtgaccgaggaggcggcggacgacctcacctccttcaagtcgagcgacgtcaactacaagctcgccctctgggatccccgggtcagcggggtccgctacctgaagacgctcatcttcaacctggccgagaacctgggcgaggcgaaccgggcccggttgcgccggatcgccaaccgggacgtcggcgaccccatctccgtcgtctgggacggcgaccggatctgcatggactatctccaggcggtgctggagctggagttcttctcccgccacgtgccactggacggcgcgacggtgctggagatcggcgcgggctacggccgcacctgtcacgccgtgctctccaaccacgacgtcgccgcgtaccacgtggtcgacctgccgaactccctcgctctggcccgccgctacctgggcacggtgctcaccgccgagcagttggcgagggtccacttccacggcgtcggcgaggtggacgggccgctgagcgagctgcgctacgacctcgtgatcaacatcgactcgttcgcggagatgacggcggagacggtgcgcgcgtacctcgccttcgtcgccaccagggcccgccacctgtacgtcaacaaccccgtcgggaagtacctcgacaagagcctggacgggcacttccagggcgaggccgtggtcaaccttgcgctgagcaccggcctgctgcgcgacgtcatcgacatccacgacaaccaggccgtgcggcggcagtcccgggcgttcctcgacgcgtaccggccggggccgggctgggcctgcgtggcggagagccggacgatcccgtggagctactactggcaggcgctctaccgggccggcgaggcggccccggcacccgggcgggattgaggtgaccggccgagcgggcgagcccgccgaccggcccgtcgtcgccgtcctcggcgcctccggcctggtcggcaccgctgtgctggccgcgctcgccgaccgggcggtcaccgtccgggccgtcgcccgccgggctgccgtgctgcccgccgcgccgggccgcgcggcgtttgaggtggtacgggccgacctgaccgaccggggagccctggcggcggcggtacgcgacgcgacggccgtggtcaacctcaccctggacagttccggctggcggggcgccgacgacgaccgcagcgcgcgggtcaacgtcgagctgacccgggaactcgtcgggatgctccgccccgggccgggcggcacgcccaccacactggtcttcgccggctccgcctcccaggtgggccggccgccccggatcccgatcgacggcaccgagccggaccaccccgccaccccgtacgaccggcagaagcaggccgcggagtcgctggtcgtggcggccaccggggccggcgtcgtgaacggggtgtcgctgcgactgcccaccgtgttcggcccggtgccgccgggcgccgggcccgaccggggcgtggtgtccacgatgatccgccgggcgctgtccggagcgccactgaccatgtggcacgacggccgggtgcaacggcaactgctgtacgtggccgacgccgccgccgccttcgtggcggcgctggaccaccccggggcgctgaccggccggcactggccgctcggcgacggccggggtgaacggctcggggacctgttccgcgccatcgccgccctggtggccgagcggaccggtcggccaccggtgccggtgctggccgtgcccccgcccgacgaggcccgggtcagcgacttccacgacatggtcgttgacgcctcggccttccaggcggtcaccgggtgggcgccccgggtgccgttgcgcctcgcgctggaccgcaccgtcgcggcgctcgcccgcgacgacagcggccccgaggccccgggcggcgtcggcccgacgcgggcggatcaggcccggaagccggactcgatctccaggcaggtccggtagtcgggcagcaacccacgggcgagcgcctggtcgaaggtgatcgcggtgcggtcccgctccgacaggatcggttcgacgtcctcggggatgggcaggcccagcccggggtcgagcgcgtcgagcgccagttcgttctcgaagacgtactcctgggacaggacgtacgacatgacggtgtcgtcggccagggcgacgaacatgtgcgcgaccccgaccggcaggtagaccgcctggaactcctcgctgtcgagcaccacgctgtcccacttgccgaacgtcggtgagcccacccgcacgtcgaggaccaggtcgagcacccggccgtgcgggcaggagacgaacttcgcggtgccgggcggggtacgggtgaagtgcagcccccgcagcgtcccccggcgggagacgctgtagctggtctgccgcacggggaacagcgggtacccgaccgtgtcccggaacaacgagtcgagatacggcgagaggaacaccccccggtagtccgggtagacggtgggcgcgaaggcgtacgcgccttcgacggtcagcgggcgggcggacaccggcggg

SEQ ID NO: 183 - DNA, 873 bp, Micromonospora carbonacea
  CDS (1)..(873): ORF1
atgcccggctcgccgtacaccgacctggatcgcccgccgctgtcggcggcccggctgcgccgggcgctgaccgccccgcacggcccctgggcccggctggagctacgcgccgagaccggctcgaccaacgcggacgtggcggaggcggcccgatccggcgagccggagggcctcgtggtgatcgccgagcggcagaccgccggccggggccggcgcggccgggtctggcagtcgccgccccgcgccggaatcgcgaccagcgtgctgctgcggccgggcgaggctgtcgcggagcgcgactggccgccggcccccgcgaccgggtacggctggctgcccctgctcgccggcgtcgcgctggtcgaggcggtggcccggctggccgagctggacgccgccctcaagtggcccaacgacctgctgatcggcgacgccaagtgcgcgggcatcctggccgaggcggtgcccggcccggccccggaccagcccccggcgatcgtcctcggcatcggtctcaacgtcaccctgcgcgccgacgagctgccggcgaacccgaccggcctgccggccacctcgctccagctcgccggggccgtcgccaccgaccgggacccgctgctgcgcgcactgctgcgctctgtcgccgactggtacgaccgctggcgccacgccggcggcgacgcggtggccagcgggctgcgcgacgcgtacctggcggcctgcgcgacggtcggcagaccggtgcgggtgctgctgcccggcggtgcggaggtgaccggcgtggcgaccggcgtggacgccgacggccggctgctggtcgacacccgggcgggcccgcgcaccctcgccgcaggagacgtcctgcacctgcgg

SEQ ID NO: 184 - protein, 291 aa, Micromonospora carbonacea
  ORF1
MPGSPYTDLDRPPLSAARLRRALTAPHGPWARLELRAETGSTNADVAEAARSGEPEGLVVIAERQTAGRGRRGRVWQSPPRAGIATSVLLRPGEAVAERDWPPAPATGYGWLPLLAGVALVEAVARLAELDAALKWPNDLLIGDAKCAGILAEAVPGPAPDQPPAIVLGIGLNVTLRADELPANPTGLPATSLQLAGAVATDRDPLLRALLRSVADWYDRWRHAGGDAVASGLRDAYLAACATVGRPVRVLLPGGAEVTGVATGVDADGRLLVDTRAGPRTLAAGDVLHLR

SEQ ID NO: 185 - DNA, 1581 bp, Micromonospora carbonacea
  CDS (1)..(1581): ORF2
gtgactaccgagaccgggatcaacatccacagcacggcgggcaagctggcggacctggagcgacgggtcgacgaggcggtgcacgccggatcggcgcgtgcggtgtccaagcagcacgcccggggcaagaagacggcgcgggagcggatcgggctgctgctcgacgaggggtccttcgtcgagctggacgggttcgcccggcaccggtccaccaacttcggcctggaccgcacccgcccgtacggcgacggggtgatcaccggctacggcacggtcgacgggcggcaggtctgcgtcttcgcgcaggacttcacggtcttcggcggctccctcggcgaggtgttcggcgaaaagatcgtcaaggtgatggacctggccatgaagatcggctgcccggtcgtcggcatcaacgactccggcggcgcccgcatccaggagggcgtggcgtccctcgggctctacggcgagatcttcttccgcaacgtgcgggccagcggcgtcatcccgcagatctccctgatcatgggcccgtgcgcgggcggcgcggtctattctccggcggtcaccgacttcaccgtgatggtcgaccagacctcgcacatgttcatcaccggccccgacgtgatcaagacggtcaccggcgaggacgtcgggatggaggaactgggcggtgcccgcacccacaacgcgcgcagcggcaacgcgcactacctcggcaccgacgaggaggacgcgatcgagtacgtcaaggcgctgctgtcgtacctgccgtcgaacaacctggacgagccgccggtcttcgacgccccggccgacgtggcgatcagcgacgccgaccgggagctggacagcctcgtcccggactcggcgaaccagccgtacgacatgcaccgggtcatcgagcacgtgctggacgacggggagttcctggaggtccagccgctgtacgcgcagaacatggtggtcggcttcggtcgaatcgagggacgaccggtcggcgtggtggccaaccagccgatgcacctcgccggcacgctggacatcgccgcgtcggagaaggccgcccggttcgtgcgcacctgcgacgcgttcaacatccccgtgctgaccttcgtggacgtgcccgggttcctacccggcaccggccaggagtgggacggcatcatccggcgcggcgcgaagctcatctacgcgtacgccgaggcgaccgtcccgaaggtcaccgtgatcacccgcaaggcgtacggcggggcgtacgacgtgatgggctccaagcacctgggcgcggatctgaacttcgcctggccgaccgcgcagatcgcggtgatgggcgcgcagggcgcggtgaacatcctgtaccggcaggagctggccgccgccgaggacccggccgccgtgcgcgccgagaagatcgccgagtacgaggacaccctggccaacccgtacgtcgccgccgagcgcgggtacgtcgactcggtgatcccgccgcacgagacgcgtacccagatcgtccgggcgttgcgggtgctgcgcaccaagcgcgagacgctcccggcgaagaagcacggcaacatcccgctc

SEQ ID NO: 186 - protein, 527 aa, Micromonospora carbonacea
  ORF2
VTTETGINIHSTAGKLADLERRVDEAVHAGSARAVSKQHARGKKTARERIGLLLDEGSFVELDGFARHRSTNFGLDRTRPYGDGVITGYGTVDGRQVCVFAQDFTVFGGSLGEVFGEKIVKVMDLAMKIGCPVVGINDSGGARIQEGVASLGLYGEIFFRNVRASGVIPQISLIMGPCAGGAVYSPAVTDFTVMVDQTSHMFITGPDVIKTVTGEDVGMEELGGARTHNARSGNAHYLGTDEEDAIEYVKALLSYLPSNNLDEPPVFDAPADVAISDADRELDSLVPDSANQPYDMHRVIEHVLDDGEFLEVQPLYAQNMVVGFGRIEGRPVGVVANQPMHLAGTLDIAASEKAARFVRTCDAFNIPVLTFVDVPGFLPGTGQEWDGIIRRGAKLIYAYAEATVPKVTVITRKAYGGAYDVMGSKHLGADLNFAWPTAQIAVMGAQGAVNILYRQELAAAEDPAAVRAEKIAEYEDTLANPYVAAERGYVDSVIPPHETRTQIVRALRVLRTKRETLPAKKHGNIPL

SEQ ID NO: 187 - DNA, 888 bp, Micromonospora carbonacea
  CDS (1)..(888): ORF3
atgcaccgggacctgcgggacgtccgttggcccgagccggcggacatccgcgcccgggcccgccgccgcagccggcgtacggcgatggcggcggccgcggccgtgctggccgtactctcggtcttcgccgtggcggtcggcggccgggccggcgggcacctcgcgccgccgatgtcctgggtcgacgggtggcgcgcgtctaccgagccggagcggtccggccggaccgagatcggccaggaggccctgctggacccggccgacctgggcgtgccgagcaacgtacgactgggggactctgggcttcaggagcaggtccgggtggacccgctgctccagtcgtgcgccgtgggcaaggagccgggggcggggccgccggtgtctcgctactcgcgatcccagacgctgctcctggacgacacgtcgggccaggacgggtcgatggccgtccccgtcctcacccaggacgtctaccgcctcgaccccgccccggccggccggctgctcgccgacctggaccgggcggcgaccacctgcgcccgctggagcgacacggcggttcggcccctggacgacggccgtggcgcgatctcggtggcccacacctggcagacgatcgcccgcgacttcgccggcgacgaggcggtcgtgttgcggcacaccgtgatgtccccggtggaccccacgacgggcaagcccctcgacgtggggtacccgccggaaacccggatgatcgtccgggtcggcgacctggtcaccgtcatcgtgcccgagcgcgggttgggcgtcgacgggccggacggcccccgcgagaccagcgacgcggagctgctcgaactgggccgcacggccgcccggcggatgtgcctcgccgccaacccggcgtgc

SEQ ID NO: 188 - protein, 296 aa, Micromonospora carbonacea
  ORF3
MHRDLRDVRWPEPADIRARARRRSRRTAMAAAAAVLAVLSVFAVAVGGRAGGHLAPPMSWVDGWRASTEPERSGRTEIGQEALLDPADLGVPSNVRLGDSGLQEQVRVDPLLQSCAVGKEPGAGPPVSRYSRSQTLLLDDTSGQDGSMAVPVLTQDVYRLDPAPAGRLLADLDRAATTCARWSDTAVRPLDDGRGAISVAHTWQTIARDFAGDEAVVLRHTVMSPVDPTTGKPLDVGYPPETRMIVRVGDLVTVIVPERGLGVDGPDGPRETSDAELLELGRTAARRMCLAANPAC

SEQ ID NO: 189 - DNA, 498 bp, Micromonospora carbonacea
  CDS (1)..(498): ORF4
atgccggacgccgaggggttcgacgagttctaccggggcagccggcaacgattgctgggtttcgtgtacatgatcaccggaaacctggccgaggcgcaggacgccgtgcaggaggcgtacatccgcgcatggcagcgctggccgaccgtacgcgggtacgacgatccggagggctggctgcgcgtggtggcgagccggatcgcggtgagccggtggcgcagcatgcgtagccgggcgcgggcgtacctgcggcacggtgcgccggagagcgtccccgcgccgagcaccgcgacgctggaggtggtggcggcgctacgccggctgcccgaggcgcagcgcaccgccatcgccctgcactacctgctcggcatgccggtggccgaggtggcacgggagaccgccgccccggtcggcaccgtgaaagcccgtctctcccgggggcgtgccgcgctcgccgggctgctcgccgtctctgacctggaggaggccgccgatgcg

SEQ ID NO: 190 - protein, 166 aa, Micromonospora carbonacea
  ORF4
MPDAEGFDEFYRGSRQRLLGFVYMITGNLAEAQDAVQEAYIRAWQRWPTVRGYDDPEGWLRVVASRIAVSRWRSMRSRARAYLRHGAPESVPAPSTATLEVVAALRRLPEAQRTAIALHYLLGMPVAEVARETAAPVGTVKARLSRGRAALAGLLAVSDLEEAADA

SEQ ID NO: 191 - DNA, 840 bp, Micromonospora carbonacea
  CDS (1)..(840): ORF5
gtgcgccccggcgctggtcgaccgggcccgggccgggcaccgcggccgtggcgggcgcgcggcgcgcgaaccgggccggggccgctaggctgcggccccgtggacctgatcgacggcctgagcgtcgtctggaacgaactcgtcggcgcgcaacccgacccgccaccgctgctggtcctggccaccgccgccgtcgcgctggcggtggtcgccacccgggtgccctggcgggtcgcgcgtaacgcggtgaccatcgcccacgagggcggtcatgcgctggccgccctgctcaccgggcggaagctgcgcggcatccggctgcactcggacacctccgggctcaccctgtcggccggccgccccaccgggctgggcatgatcctcaccctgttcgccgggtacgtcgccccgaccctgctcgggctggccggggcgtggctgctcgccgggaaccggatcaccatgctgctctcggtcacggtggtgctgctgctggccatgctggcgatgatccgcaacgtctacggggcactgtcgctgctcgccaccggcggtctggtcttcgccgtctcctggtacgccccgccgcaggtgcaggccgcgttcgcctggacctcggtctggttcctgctgttcggcggcgtgcgtccggtgatcgagttgcagcggctgcgcagccgtggccggatgccggagtccgacgccgaccagctcgcccggttgacgccgttcccgcccctgttctgggtcggtgtcttcctggtcgtctgcctggccggcctcgccgtcggcgccctgctgctcgccggcccgatcctcaccgacgccgggctcacggtc

SEQ ID NO: 192 - protein, 280 aa, Micromonospora carbonacea
  ORF5
VRPGAGRPGPGRAPRPWRARGARTGPGPLGCGPVDLIDGLSVVWNELVGAQPDPPPLLVLATAAVALAVVATRVPWRVARNAVTIAHEGGHALAALLTGRKLRGIRLHSDTSGLTLSAGRPTGLGMILTLFAGYVAPTLLGLAGAWLLAGNRITMLLSVTVVLLLAMLAMIRNVYGALSLLATGGLVFAVSWYAPPQVQAAFAWTSVWFLLFGGVRPVIELQRLRSRGRMPESDADQLARLTPFPPLFWVGVFLVVCLAGLAVGALLLAGPILTDAGLTV

SEQ ID NO: 193 - DNA, 753 bp, Micromonospora carbonacea
  CDS (1)..(753): ORF6
gtgacttaccggcacgaaaccgtacgcggtgcgtacggcgacctggccagtggcgccgtgttgcgctcggcgccgggcttcccggcgttcccggtgcggctcgcctccgaggtcctgcaaaccgcgctggagttgcgcccgacgtccgccccggccaccgtctgggacccgtgctgcggcagcggctacctgctgacggtgctcgcgctgctgcaccggccgagccttgccgggctgctcgcctccgacgtcgacgaggcggccctcgaccttgctcgggccaacctcggcctgctgaccggcgccgggctcgacacgcgggcccgcgagctggcgcaacgcgccgaggcgttcgacaagccgcactacgcggaggcggccgccgccgcccaccggctgcgcgcccgtctggacgcggcaggcggcccgctgccgtacgcggtgcggcgggccgacgtgttcgaccgcgtggccctcaccgaggccgtcgcgggcatgacccccgacctggtcgtgaccgacctgccgtacggggagcagacgagctggcagggggagcgggccggggagggcctgcccgggatgctgaccagggtcgcttccgtgctgccgccgaccggggtgctcgccgtggtcctacgtggacgcaaggtgccgccggtcggtgaggtccgccctcggcggcggttgcgggtgggcaccagagcggcggccttcttcgtcgcaggcgacctgaccggggtgcccgcgacc

SEQ ID NO: 194 - protein, 251 aa, Micromonospora carbonacea
  ORF6
VTYRHETVRGAYGDLASGAVLRSAPGFPAFPVRLASEVLQTALELRPTSAPATVWDPCCGSGYLLTVLALLHRPSLAGLLASDVDEAALDLARANLGLLTGAGLDTRARELAQRAEAFDKPHYAEAAAAAHRLRARLDAAGGPLPYAVRRADVFDRVALTEAVAGMTPDLVVTDLPYGEQTSWQGERAGEGLPGMLTRVASVLPPTGVLAVVLRGRKVPPVGEVRPRRRLRVGTRAAAFFVAGDLTGVPAT

SEQ ID NO: 195 - DNA, 1086 bp, Micromonospora carbonacea
  CDS (1)..(1086): ORF7
atgaccgtcccggacacggacgagcgggccacgacgaccgacgagcccagcgcccgccgggcgcagaccggcgcggacgccgcctggccggagctgatgcggttggtgttcggcgggatggccagccggctggtcggctactgcgtccggctggggctgcccgacgcgatcggcgacgacgagcgcaccccgcaggagttggcgctgcggtacgacgcccgagcggacaccatgttccgggtgctgcgcgccctggccgcgctgcgggtgctcaccgagaccacacccggccggttcgcgctcgccccgatgggggcgctgctgcgtggggaccgacccggcacgctgcgcccgctggcccggatgctgaccgacccggccatgaccacggcctgggacggcctggcgcacagcgtccgcaccggcgagccggccttcgacggcatcttcggcaccgacttcttcagctacgtgggcgggcgacccgacctttccgagctgtacaacgcggcgatgagccaggtgacccacagcgtcgcggcggccgttgccgagcgtaccgacctggccggcgtgcggacggtggtcgacgtgggcggcggagacggcaccctgctggccgccgtgctcgccgcgaaccccggcgtgcggggcgtgctctacgacagcgccagcggcagcgcggaggcggcggggaacctgcgccgcgccggggtcggcgaccggtgccggatcgaggtgggtgacttcttcgagagggtccccgccgacgccgacctctacctgctcaaaagtgtgatccacggttggggcgacggccgggcgacgggaatcctccggcactgtgccgaggcggtcgccccgggcggccggatcgtcatgatcgaccacgtgctgccggacgtggtcggcccggcggccaacgcgctggcgtacctgaccgacgtggggatgctggtcaacgggcagggcctggagcggacccgaggcgacctggaacggctgtgcggcaaggcggggctgtccctggaggacgtcacgccgctgcctcccaccgacttccactggatcgagtcccggcctgcc

SEQ ID NO: 196 - protein, 362 aa, Micromonospora carbonacea
  ORF7
MTVPDTDERATTTDEPSARRAQTGADAAWPELMRLVFGGMASRLVGYCVRLGLPDAIGDDERTPQELALRYDARADTMFRVLRALAALRVLTETTPGRFALAPMGALLRGDRPGTLRPLARMLTDPAMTTAWDGLAHSVRTGEPAFDGIFGTDFFSYVGGRPDLSELYNAAMSQVTHSVAAAVAERTDLAGVRTVVDVGGGDGTLLAAVLAANPGVRGVLYDSASGSAEAAGNLRRAGVGDRCRIEVGDFFERVPADADLYLLKSVIHGWGDGRATGILRHCAEAVAPGGRIVMIDHVLPDVVGPAANALAYLTDVGMLVNGQGLERTRGDLERLCGKAGLSLEDVTPLPPTDFHWIESRPA

SEQ ID NO: 197 - DNA, 852 bp, Micromonospora carbonacea
  CDS (1)..(852): ORF8
atgagcgcccaggtcctcagcgacgagcaggtcgagcggttcgtctccgacgggttcgtgaagttggaggcggcgttcccggccgagctcgcgcagcagggtcgcgaactgctgtggcggcaactcggcatggaccccgaggaccggagcacctggtcccgcgaggtggtccggctgggcctccaggacgccgagcccttcgtgcgcagcgccaccacgccccggctgcacgccgccttcgaccagctcgtcggggtggggcgctggaagccgttggaccggatcggcaccttcccggtccggttcccggtgcccaagcgcccggagcagaccgaggactacggctggcacatcgacgccagtttcctggccgacgacgcgcagcggctgggcccccagaactgggagggcgagctggacctggtcccgcccaactacgcggaggtcttccgctgcaacctccggtcgcgggggcgggccctgctgctgctgttcctcttctccgacaccgacgagcgggaggcgccgacgctggtcagggtcggctcccacctggacgtgccgccgctgctcgaaccgtacggcccggagggcacctacctcgacgtgggcgacgtcggccgggaccgcccgctcgcctccgccaccggacgcgccggtgacgtctacctgtgccacccgttcctggtgcacaccccggtggccaacaccggcacgcggccccggttcatggcccagccgagcctgcagccggtgggcgagctggacctggaccgcccggacggcgactactcgccggtcgaacgggccgtgcgcatcgggctgggcctgccggccgccgagccggtccga

SEQ ID NO: 198 - protein, 284 aa, Micromonospora carbonacea
  ORF8
MSAQVLSDEQVERFVSDGFVKLEAAFPAELAQQGRELLWRQLGMDPEDRSTWSREVVRLGLQDAEPFVRSATTPRLHAAFDQLVGVGRWKPLDRIGTFPVRFPVPKRPEQTEDYGWHIDASFLADDAQRLGPQNWEGELDLVPPNYAEVFRCNLRSRGRALLLLFLFSDTDEREAPTLVRVGSHLDVPPLLEPYGPEGTYLDVGDVGRDRPLASATGRAGDVYLCHPFLVHTPVANTGTRPRFMAQPSLQPVGELDLDRPDGDYSPVERAVRIGLGLPAAEPVR

SEQ ID NO: 199 - DNA, 1062 bp, Micromonospora carbonacea
  CDS (1)..(1062): ORF9
gtggagtaccgacagttgggccggtgtggactgcgggtgtccaaggtgtccctgggggcgttcaacttcggcggcccgaccgggccggaggaggccgccaggatcgtcgccacggccgtcgaagcgggagtcaacctcgtcgacacggccaacgtctaccaggacggccgcagcgaggagatcgtcggcgcggccgtgcggagctgccgggacgacgtcctgctggccaccaagatcttcaatccggtcggcccgggaccgaacgaccggggcacctcggcgtacgccctgaagcgggagtgcgagcggtcgttgcgccggctgggtaccgaccacatcgacctgctctacctgcaccgtcacgacccggacactccggtggaggagacggtgtccgccctcgacgacctggtccgctcgggcaaggtccgctacgtgggcacctccaccgtgcccacggcatacgagctggccgaccagccccggctgggcacggtgcccagctggcggatcgtcgacctgctgcgcacggcgcagtcccggggcgccgccccggtggtggccgagcagtcgccgtacaacctgctggaacgcgagatcgagcgggacgtgctgccgctgtgcgcggagtacggcctcggcctgttcacctacagcccgctggcgatgggtctgctctccgaccggttcgccgacggcgagccgccccgcgacgcccggttcaccgcctggtacgccccatcgggcccgcactggcagccggtgtggcggaccctgggccggttggcgaaggtggccgtcgagctgggcctgtccctgccggacctggcgcacgcctgggtctacgacgcgccgggggtgaccagcacggtcgtcggcccccgcacgctggaccaggcccgggcggcgctggcggcggccgaccggccgctgccggaggaggcccgcgcccggctcgacggcatcgccgcacccggggagagccgatggttgcgggtggtggagcggggggtgcggcgctctcgcggtggcccggacgatgctgaggaaaacgttagtccc

SEQ ID NO: 200 - protein, 354 aa, Micromonospora carbonacea
  ORF9
VEYRQLGRCGLRVSKVSLGAFNFGGPTGPEEAARIVATAVEAGVNLVDTANVYQDGRSEEIVGAAVRSCRDDVLLATKIFNPVGPGPNDRGTSAYALKRECERSLRRLGTDHIDLLYLHRHDPDTPVEETVSALDDLVRSGKVRYVGTSTVPTAYELADQPRLGTVPSWRIVDLLRTAQSRGAAPVVAEQSPYNLLEREIERDVLPLCAEYGLGLFTYSPLAMGLLSDRFADGEPPRDARFTAWYAPSGPHWQPVWRTLGRLAKVAVELGLSLPDLAHAWVYDAPGVTSTVVGPRTLDQARAALAAADRPLPEEARARLDGIAAPGESRWLRVVERGVRRSRGGPDDAEENVSP

SEQ ID NO: 201 - DNA, 927 bp, Micromonospora carbonacea
  CDS (1)..(927): ORF10
atgagcgacaagtacggccgcagtgcgctgtgggaacggtacaacagcacacaggtgaccgaggaggcggcggacgacctcacctccttcaagtcgagcgacgtcaactacaagctcgccctctgggatccccgggtcagcggggtccgctacctgaagacgctcatcttcaacctggccgagaacctgggcgaggcgaaccgggcccggttgcgccggatcgccaaccgggacgtcggcgaccccatctccgtcgtctgggacggcgaccggatctgcatggactatctccaggcggtgctggagctggagttcttctcccgccacgtgccactggacggcgcgacggtgctggagatcggcgcgggctacggccgcacctgtcacgccgtgctctccaaccacgacgtcgccgcgtaccacgtggtcgacctgccgaactccctcgctctggcccgccgctacctgggcacggtgctcaccgccgagcagttggcgagggtccacttccacggcgtcggcgaggtggacgggccgctgagcgagctgcgctacgacctcgtgatcaacatcgactcgttcgcggagatgacggcggagacggtgcgcgcgtacctcgccttcgtcgccaccagggcccgccacctgtacgtcaacaaccccgtcgggaagtacctcgacaagagcctggacgggcacttccagggcgaggccgtggtcaaccttgcgctgagcaccggcctgctgcgcgacgtcatcgacatccacgacaaccaggccgtgcggcggcagtcccgggcgttcctcgacgcgtaccggccggggccgggctgggcctgcgtggcggagagccggacgatcccgtggagctactactggcaggcgctctaccgggccggcgaggcggccccggcacccgggcgggat

SEQ ID NO: 202 - protein, 309 aa, Micromonospora carbonacea
  ORF10
MSDKYGRSALWERYNSTQVTEEAADDLTSFKSSDVNYKLALWDPRVSGVRYLKTLIFNLAENLGEANRARLRRIANRDVGDPISVVWDGDRICMDYLQAVLELEFFSRHVPLDGATVLEIGAGYGRTCHAVLSNHDVAAYHVVDLPNSLALARRYLGTVLTAEQLARVHFHGVGEVDGPLSELRYDLVINIDSFAEMTAETVRAYLAFVATRARHLYVNNPVGKYLDKSLDGHFQGEAVVNLALSTGLLRDVIDIHDNQAVRRQSRAFLDAYRPGPGWACVAESRTIPWSYYWQALYRAGEAAPAPGRD

SEQ ID NO: 203 - DNA, 999 bp, Micromonospora carbonacea
  CDS (1)..(999): ORF11
gtgctggccgcgctcgccgaccgggcggtcaccgtccgggccgtcgcccgccgggctgccgtgctgcccgccgcgccgggccgcgcggcgtttgaggtggtacgggccgacctgaccgaccggggagccctggcggcggcggtacgcgacgcgacggccgtggtcaacctcaccctggacagttccggctggcggggcgccgacgacgaccgcagcgcgcgggtcaacgtcgagctgacccgggaactcgtcgggatgctccgccccgggccgggcggcacgcccaccacactggtcttcgccggctccgcctcccaggtgggccggccgccccggatcccgatcgacggcaccgagccggaccaccccgccaccccgtacgaccggcagaagcaggccgcggagtcgctggtcgtggcggccaccggggccggcgtcgtgaacggggtgtcgctgcgactgcccaccgtgttcggcccggtgccgccgggcgccgggcccgaccggggcgtggtgtccacgatgatccgccgggcgctgtccggagcgccactgaccatgtggcacgacggccgggtgcaacggcaactgctgtacgtggccgacgccgccgccgccttcgtggcggcgctggaccaccccggggcgctgaccggccggcactggccgctcggcgacggccggggtgaacggctcggggacctgttccgcgccatcgccgccctggtggccgagcggaccggtcggccaccggtgccggtgctggccgtgcccccgcccgacgaggcccgggtcagcgacttccacgacatggtcgttgacgcctcggccttccaggcggtcaccgggtgggcgccccgggtgccgttgcgcctcgcgctggaccgcaccgtcgcggcgctcgcccgcgacgacagcggccccgaggccccgggcggcgtcggcccgacgcgggcggatcaggcccggaagccggactcgatctccaggcaggtccgg

SEQ ID NO: 204 - protein, 333 aa, Micromonospora carbonacea
  ORF11
VLAALADRAVTVRAVARRAAVLPAAPGRAAFEVVRADLTDRGALAAAVRDATAVVNLTLDSSGWRGADDDRSARVNVELTRELVGMLRPGPGGTPTTLVFAGSASQVGRPPRIPIDGTEPDHPATPYDRQKQAAESLVVAATGAGVVNGVSLRLPTVFGPVPPGAGPDRGVVSTMIRRALSGAPLTMWHDGRVQRQLLYVADAAAAFVAALDHPGALTGRHWPLGDGRGERLGDLFRAIAALVAERTGRPPVPVLAVPPPDEARVSDFHDMVVDASAFQAVTGWAPRVPLRLALDRTVAALARDDSGPEAPGGVGPTRADQARKPDSISRQVR

What is claimed is:

1. An isolated nucleic acid comprising the nucleotide sequence of SEQ ID NO:1.

2. A vector comprising a nucleic acid of claim 1.

3. A host comprising a vector of claim 2.

4. A host cell of claim 3, which is a bacterial host cell.

5. A host cell of claim 4, which is an *E. coli* or an actinomycete.

6. A host cell of claim 5, which is *Streptomyces* or *Micrornonospora*.

7. A method for expressing an everninomicin biosynthetic pathway gene product from a *Micromonospora carbonacoa*, comprising culturing a host cell of claim 6 under conditions that permit expression of the everninomicin biosynthetic pathway gene product.

8. A method for selecting for growth of a host cell comprising an everninomycin-resistant growth phebotype, comprising growing a host cell containing the vector of claim 2 in the presence of an amount of everninomicin that is toxic to a host cell which does not contain the vector.

9. A vector for genetic integration in an actinomycete host cell comprising the nucleic acid of claim 1.

10. A vector of claim 9, further comprising a heterologous gene.

11. A method for introducing a heterologous gene into an actinomycete, comprising introducing the vector of claim 10 into the actinomycete.

12. The method according to claim 11, wherein the actinomycete is of the genus *Micromonospora*.

* * * * *

UNITED STATES PATENT AND TRADEMARK OFFICE
CERTIFICATE OF CORRECTION

PATENT NO.    : 6,861,513 B2
DATED         : March 1, 2005
INVENTOR(S)   : Thomas J. Hosted, Tim X. Wang and Ann C. Horan It is certified that error appears in the above-identified patent and that said Letters Patent is hereby corrected as shown below:

Column 43,
Line 23, change "Micrornonospora" to -- Micromonospora --

Column 44,
Line 15, change "phebotype" to -- phenotype --

Signed and Sealed this

Seventeenth Day of May, 2005

JON W. DUDAS
*Director of the United States Patent and Trademark Office*